United States Patent 8,809,059 (PLANTS WITH INCREASED YIELD) - sequence listing, part 5

SEQ ID NO: 11485 - DNA, 1578 bp, Saccharomyces cerevisiae
  CDS (1)..(1578)
atgaatgaaatcgatgagaaaaatcaggcccccgtgcaacaagaatgcctgaaagagatgattcagaatgggcatgctcggcgtatgggatctgttgaagatctgtatgttgctctcaacagacaaaacttatatcgaaacttctgcacatatggagaattgagtgattactgtactagggatcagctcacattagctttgagggaaatctgcctgaaaaatccaactcttttacatattgttctaccaacaagatggccaaatcatgaaaattattatcgcagttccgaatactattcacggccacatccagtgcatgattatatttcagtattacaagaattgaaactgagtggtgtggttctcaatgaacaacctgagtacagtgcagtaatgaagcaaatattagaagaattcaaaaatagtaagggttcctatactgcaaaaatttttaaacttactaccactttgactattccttactttggaccaacaggaccgagttggcggctaatttgtcttccagaagagcacacagaaaagtggaaaaaatttatctttgtatctaatcattgcatgtctgatggtcggtcttcgatccacttttttcatgatttaagagacgaattaaataatattaaaactccaccaaaaaaattagattacattttcaagtacgaggaggattaccaattattgaggaaacttccagaaccgatcgaaaaggtgatagactttagaccaccgtacttgtttattccgaagtcacttctttcgggtttcatctacaatcatttgagattttcttcaaaaggtgtctgtatgagaatggatgatgtggaaaaaaccgatgatgttgtcaccgagatcatcaatatttcaccaacagaatttcaagcgattaaagcaaatattaaatcaaatatccaaggtaagtgtactatcactccgtttttacatgtttgttggtttgtatctcttcataaatggggtaaatttttcaaaccattgaacttcgaatggcttacggatatttttatccccgcagattgccgctcacaactaccagatgatgatgaaatgagacagatgtacagatatggcgctaacgttggatttattgacttcaccccctggataagcgaatttgacatgaatgataacaaagaaaatttttggccacttattgagcactaccatgaagtaatttcggaagctttaagaaataaaaagcatctccatggcttagggttcaatatacaaggcttcgttcaaaaatatgtgaacattgacaaggtaatgtgcgatcgtgccatcgggaaaagacgcggaggtacattgttaagcaatgtaggtctgtttaatcagttagaggagcccgatgccaaatattctatatgcgatttggcatttggccaatttcaaggatcctggcaccaagcattttccttgggtgtttgttcgactaatgtaaaggggatgaatattgttgttgcttcaacaaagaatgttgttggtagtcaagaatctctcgaagagctttgctccatttacaaagctctccttttaggcccttag

SEQ ID NO: 11486 - protein, 525 aa, Saccharomyces cerevisiae
MNEIDEKNQAPVQQECLKEMIQNGHARRMGSVEDLYVALNRQNLYRNFCTYGELSDYCTRDQLTLALREICLKNPTLLHIVLPTRWPNHENYYRSSEYYSRPHPVHDYISVLQELKLSGVVLNEQPEYSAVMKQILEEFKNSKGSYTAKIFKLTTTLTIPYFGPTGPSWRLICLPEEHTEKWKKFIFVSNHCMSDGRSSIHFFHDLRDELNNIKTPPKKLDYIFKYEEDYQLLRKLPEPIEKVIDFRPPYLFIPKSLLSGFIYNHLRFSSKGVCMRMDDVEKTDDVVTEIINISPTEFQAIKANIKSNIQGKCTITPFLHVCWFVSLHKWGKFFKPLNFEWLTDIFIPADCRSQLPDDDEMRQMYRYGANVGFIDFTPWISEFDMNDNKENFWPLIEHYHEVISEALRNKKHLHGLGFNIQGFVQKYVNIDKVMCDRAIGKRRGGTLLSNVGLFNQLEEPDAKYSICDLAFGQFQGSWHQAFSLGVCSTNVKGMNIVVASTKNVVGSQESLEELCSIYKALLLGP

SEQ ID NO: 11487 - DNA, 25 bp, Artificial sequence
  primer
atggaagatatagaaggatacgaac

SEQ ID NO: 11488 - DNA, 24 bp, Artificial sequence
  primer
ttaaagcgacgcaaattcgccgat

SEQ ID NO: 11489 - protein, 525 aa, Artificial sequence
  consensus sequence
  Variant (2)..(3): Xaa in position 2 to 3 is any amino acid
  Variant (6)..(6): Xaa in position 6 is any amino acid
  Variant (11)..(12): Xaa in position 11 to 12 is any amino acid
  Variant (14)..(18): Xaa in position 14 to 18 is any amino acid
  Variant (20)..(20): Xaa in position 20 is any amino acid
  Variant (23)..(24): Xaa in position 23 to 24 is any amino acid
  Variant (26)..(26): Xaa in position 26 is any amino acid
  Variant (29)..(30): Xaa in position 29 to 30 is any amino acid
  Variant (32)..(32): Xaa in position 32 is any amino acid
  Variant (35)..(41): Xaa in position 35 to 41 is any amino acid
  Variant (44)..(44): Xaa in position 44 is any amino acid
  Variant (46)..(46): Xaa in position 46 is any amino acid
  Variant (48)..(52): Xaa in position 48 to 52 is any amino acid
  Variant (54)..(56): Xaa in position 54 to 56 is any amino acid
  Variant (58)..(58): Xaa in position 58 is any amino acid
  Variant (60)..(62): Xaa in position 60 to 62 is any amino acid
  Variant (64)..(66): Xaa in position 64 to 66 is any amino acid
  Variant (68)..(68): Xaa in position 68 is any amino acid
  Variant (71)..(71): Xaa in position 71 is any amino acid
  Variant (74)..(74): Xaa in position 74 is any amino acid
  Variant (76)..(76): Xaa in position 76 is any amino acid
  Variant (79)..(81): Xaa in position 79 to 81 is any amino acid
  Variant (83)..(83): Xaa in position 83 is any amino acid
  Variant (85)..(85): Xaa in position 85 is any amino acid
  Variant (88)..(88): Xaa in position 88 is any amino acid
  Variant (90)..(90): Xaa in position 90 is any amino acid
  Variant (92)..(94): Xaa in position 92 to 94 is any amino acid
  Variant (95)..(95): Xaa in position 95 is any or no amino acid
  Variant (97)..(103): Xaa in position 97 to 103 is any amino acid
  Variant (105)..(105): Xaa in position 105 is any amino acid
  Variant (109)..(115): Xaa in position 109 to 115 is any amino acid
  Variant (116)..(116): Xaa in position 116 is any or no amino acid
  Variant (118)..(118): Xaa in position 118 is any amino acid
  Variant (120)..(128): Xaa in position 120 to 128 is any amino acid
  Variant (130)..(134): Xaa in position 130 to 134 is any amino acid
  Variant (136)..(140): Xaa in position 136 to 140 is any amino acid
  Variant (143)..(145): Xaa in position 143 to 145 is any amino acid
  Variant (147)..(148): Xaa in position 147 to 148 is any amino acid
  Variant (150)..(150): Xaa in position 150 is any amino acid
  Variant (158)..(163): Xaa in position 158 to 163 is any amino acid
  Variant (164)..(167): Xaa in position 164 to 167 is any or no amino acid
  Variant (170)..(170): Xaa in position 170 is any amino acid
  Variant (172)..(173): Xaa in position 172 to 173 is any amino acid
  Variant (175)..(175): Xaa in position 175 is any amino acid
  Variant (179)..(179): Xaa in position 179 is any amino acid
  Variant (183)..(183): Xaa in position 183 is any amino acid
  Variant (185)..(187): Xaa in position 185 to 187 is any amino acid
  Variant (190)..(190): Xaa in position 190 is any amino acid
  Variant (193)..(198): Xaa in position 193 to 198 is any amino acid
  Variant (200)..(208): Xaa in position 200 to 208 is any amino acid
  Variant (209)..(215): Xaa in position 209 to 215 is any or no amino acid
  Variant (217)..(218): Xaa in position 217 to 218 is any amino acid
  Variant (220)..(221): Xaa in position 220 to 221 is any amino acid
  Variant (224)..(227): Xaa in position 224 to 227 is any amino acid
  Variant (231)..(231): Xaa in position 231 is any amino acid
  Variant (234)..(236): Xaa in position 234 to 236 is any amino acid
  Variant (239)..(240): Xaa in position 239 to 240 is any amino acid
  Variant (242)..(246): Xaa in position 242 to 246 is any amino acid
  Variant (249)..(250): Xaa in position 249 to 250 is any amino acid
  Variant (252)..(253): Xaa in position 252 to 253 is any amino acid
  Variant (255)..(260): Xaa in position 255 to 260 is any amino acid
  Variant (262)..(268): Xaa in position 262 to 268 is any amino acid
  Variant (269)..(272): Xaa in position 269 to 272 is any or no amino acid
  Variant (274)..(288): Xaa in position 274 to 288 is any amino acid
  Variant (289)..(296): Xaa in position 289 to 296 is any or no amino acid
  Variant (298)..(303): Xaa in position 298 to 303 is any amino acid
  Variant (305)..(307): Xaa in position 305 to 307 is any amino acid
  Variant (310)..(310): Xaa in position 310 is any amino acid
  Variant (312)..(315): Xaa in position 312 to 315 is any amino acid
  Variant (318)..(318): Xaa in position 318 is any amino acid
  Variant (322)..(324): Xaa in position 322 to 324 is any amino acid
  Variant (326)..(327): Xaa in position 326 to 327 is any amino acid
  Variant (329)..(329): Xaa in position 329 is any amino acid
  Variant (331)..(334): Xaa in position 331 to 334 is any amino acid
  Variant (336)..(336): Xaa in position 336 is any amino acid
  Variant (338)..(342): Xaa in position 338 to 342 is any amino acid
  Variant (343)..(348): Xaa in position 343 to 348 is any or no amino acid
  Variant (350)..(352): Xaa in position 350 to 352 is any amino acid
  Variant (354)..(356): Xaa in position 354 to 356 is any amino acid
  Variant (358)..(360): Xaa in position 358 to 360 is any amino acid
  Variant (362)..(363): Xaa in position 362 to 363 is any amino acid
  Variant (366)..(366): Xaa in position 366 is any amino acid
  Variant (368)..(368): Xaa in position 368 is any amino acid
  Variant (370)..(370): Xaa in position 370 is any amino acid
  Variant (372)..(373): Xaa in position 372 to 373 is any amino acid
  Variant (375)..(375): Xaa in position 375 is any amino acid
  Variant (378)..(378): Xaa in position 378 is any amino acid
  Variant (382)..(388): Xaa in position 382 to 388 is any amino acid
  Variant (391)..(391): Xaa in position 391 is any amino acid
  Variant (393)..(399): Xaa in position 393 to 399 is any amino acid
  Variant (400)..(401): Xaa in position 400 to 401 is any or no amino acid
  Variant (404)..(404): Xaa in position 404 is any amino acid
  Variant (406)..(406): Xaa in position 406 is any amino acid
  Variant (408)..(408): Xaa in position 408 is any amino acid
  Variant (410)..(421): Xaa in position 410 to 421 is any amino acid
  Variant (424)..(424): Xaa in position 424 is any amino acid
  Variant (428)..(438): Xaa in position 428 to 438 is any amino acid
  Variant (440)..(440): Xaa in position 440 is any amino acid
  Variant (442)..(452): Xaa in position 442 to 452 is any amino acid
  Variant (456)..(458): Xaa in position 456 to 458 is any amino acid
  Variant (461)..(461): Xaa in position 461 is any amino acid
  Variant (463)..(465): Xaa in position 463 to 465 is any amino acid
  Variant (467)..(471): Xaa in position 467 to 471 is any amino acid
  Variant (472)..(473): Xaa in position 472 to 473 is any or no amino acid
  Variant (475)..(477): Xaa in position 475 to 477 is any amino acid
  Variant (480)..(480): Xaa in position 480 is any amino acid
  Variant (482)..(482): Xaa in position 482 is any amino acid
  Variant (484)..(485): Xaa in position 484 to 485 is any amino acid
  Variant (487)..(490): Xaa in position 487 to 490 is any amino acid
  Variant (493)..(493): Xaa in position 493 is any amino acid
  Variant (495)..(495): Xaa in position 495 is any amino acid
  Variant (497)..(497): Xaa in position 497 is any amino acid
  Variant (502)..(502): Xaa in position 502 is any amino acid
  Variant (506)..(520): Xaa in position 506 to 520 is any amino acid
  Variant (521)..(521): Xaa in position 521 is any or no amino acid
  Variant (523)..(524): Xaa in position 523 to 524 is any amino acid
IXXGHXRRMGXXEXXXXXLXRQXXYXNFXXYXELXXXXXXXQLXLXLXXXXXKXXXLXHXXXPXXXPXHEXYYXSXEYXXXPXPXHDXIXVXXXXLXXXXXXXNXQPEXXXXXXXXIXEXXXXXXXXXTXXXXXLXXXXXIPXXXPXXPXWRLICLPXXXXXXXXXXWKXFXXVXNHCXSDGXSXXXFFXDLXXXXXXIXXXXXXXXXXXXXXXXIXXYXXDYXXXXKLPXPIXXXIDXXPXXXXXPKXXLXXFXXXXXXFXXXXXXXXXXXRXXXXXXXXXXXXXXXXXXXXXXXSXXXXXXIXXXIKXNXXXXCTXTPFXXXCXXVXLXXXXKXFXXXXXXXXXXXEXXXDXXXPXXXRXXLPXDXEXRXXYXYGXNVGXXXXXXXISXFXXXXXXXXXFWXLXEXYXXXXXXXXXXXXHLXGLGXXXXXXXXXXXNXDXXXXXXXXXXXRGGXXXSNXGXXXQXXXXXXXYXXXDLXFXQXXGXXXXAFXLXVXSTNVXGMNXXXXXXXXXXXXXXXXEXXC

SEQ ID NO: 11490 - protein, 53 aa, Artificial sequence
  protein pattern
  Variant (5)..(5): Xaa in position 5 is any amino acid
  Variant (6)..(6): Xaa in position 6 is Leu or Val
  Variant (8)..(8): Xaa in position 8 is any amino acid
  Variant (9)..(12): Xaa in position 9 to 12 is any or no amino acid
  Variant (14)..(14): Xaa in position 14 is Asn, Arg or Ser
  Variant (17)..(17): Xaa in position 17 is any amino acid
  Variant (18)..(18): Xaa in position 18 is Leu or Met
  Variant (20)..(20): Xaa in position 20 is Arg or Ser
  Variant (23)..(23): Xaa in position 23 is Ala, Cys, Ser or Thr
  Variant (24)..(24): Xaa in position 24 is Thr or Val
  Variant (26)..(26): Xaa in position 26 is Ala, Gly or Ser
  Variant (29)..(29): Xaa in position 29 is Asn or Ser
  Variant (30)..(30): Xaa in position 30 is Asp or Lys
  Variant (31)..(31): Xaa in position 31 is any amino acid
  Variant (32)..(32): Xaa in position 32 is Cys or Val
  Variant (33)..(33): Xaa in position 33 is Asn, Ser or Thr
  Variant (34)..(34): Xaa in position 34 is Lys or Arg
  Variant (35)..(35): Xaa in position 35 is Asp or Arg
  Variant (38)..(38): Xaa in position 38 is any amino acid
  Variant (40)..(40): Xaa in position 40 is Ala or Val
  Variant (42)..(42): Xaa in position 42 is Lys or Arg
  Variant (43)..(43): Xaa in position 43 is any amino acid
  Variant (44)..(44): Xaa in position 44 is Ile or Leu
  Variant (45)..(46): Xaa in position 45 to 46 is any amino acid
  Variant (48)..(48): Xaa in position 48 is any amino acid
  Variant (49)..(49): Xaa in position 49 is Pro or Ser
  Variant (50)..(50): Xaa in position 50 is any amino acid
  Variant (52)..(52): Xaa in position 52 is any amino acid
RRMGXXEXXXXXLXRQXXYXNFXXYXELXXXXXXXQLXLXLXXXXXKXXXLXH

SEQ ID NO: 11491 - protein, 38 aa, Artificial sequence
  protein pattern
  Variant (2)..(4): Xaa in position 2 to 4 is any amino acid
  Variant (6)..(6): Xaa in position 6 is Ala or Ser
  Variant (7)..(7): Xaa in position 7 is Asp, Asn or Ser
  Variant (8)..(8): Xaa in position 8 is Ala, Cys or Thr
  Variant (10)..(10): Xaa in position 10 is Arg or Ser
  Variant (11)..(11): Xaa in position 11 is any amino acid
  Variant (14)..(14): Xaa in position 14 is any or no amino acid
  Variant (16)..(16): Xaa in position 16 is any amino acid
  Variant (17)..(17): Xaa in position 17 is any or no amino acid
  Variant (19)..(19): Xaa in position 19 is Leu, Met or Val
  Variant (21)..(21): Xaa in position 21 is Ala, Asp or Gln
  Variant (22)..(22): Xaa in position 22 is any amino acid
  Variant (24)..(24): Xaa in position 24 is Lys or Arg
  Variant (27)..(27): Xaa in position 27 is Ala or Ser
  Variant (31)..(32): Xaa in position 31 to 32 is any amino acid
  Variant (33)..(33): Xaa in position 33 is Asp or His
  Variant (34)..(34): Xaa in position 34 is Phe or Tyr
  Variant (35)..(35): Xaa in position 35 is Ala or Thr
  Variant (36)..(37): Xaa in position 36 to 37 is any amino acid
DXXXPXXXRXXLPXDXXEXRXXYXYGXNVGXXXXXXXI

SEQ ID NO: 11492 - protein, 20 aa, Artificial sequence
  protein pattern
  Variant (2)..(5): Xaa in position 2 to 5 is any amino acid
  Variant (8)..(8): Xaa in position 8 is Gly or Ser
  Variant (10)..(10): Xaa in position 10 is Gly or Asn
  Variant (12)..(12): Xaa in position 12 is Cys or Ser
  Variant (17)..(17): Xaa in position 17 is any amino acid
GXXXXAFXLXVXSTNVXGMN

SEQ ID NO: 11493 - protein, 39 aa, Artificial sequence
  protein pattern
  Variant (2)..(3): Xaa in position 2 to 3 is any or no amino acid
  Variant (5)..(5): Xaa in position 5 is any or no amino acid
  Variant (7)..(7): Xaa in position 7 is Lys or Arg
  Variant (8)..(8): Xaa in position 8 is Ala, Ser or Thr
  Variant (9)..(9): Xaa in position 9 is any amino acid
  Variant (12)..(13): Xaa in position 12 to 13 is any amino acid
  Variant (14)..(14): Xaa in position 14 is Ile or Val
  Variant (15)..(15): Xaa in position 15 is any amino acid
  Variant (16)..(16): Xaa in position 16 is Ala, Asp or Gly
  Variant (17)..(17): Xaa in position 17 is any amino acid
  Variant (20)..(20): Xaa in position 20 is Ile or Leu
  Variant (24)..(24): Xaa in position 24 is Ile or Leu
  Variant (25)..(25): Xaa in position 25 is any amino acid
  Variant (26)..(26): Xaa in position 26 is Ala or Val
  Variant (28)..(28): Xaa in position 28 is Phe or Trp
  Variant (29)..(29): Xaa in position 29 is Phe or Leu
  Variant (31)..(31): Xaa in position 31 is Ala, Ser or Thr
  Variant (33)..(33): Xaa in position 33 is His or Tyr
  Variant (34)..(34): Xaa in position 34 is Lys or Arg
  Variant (35)..(35): Xaa in position 35 is any amino acid
  Variant (36)..(36): Xaa in position 36 is Asp or Gly
  Variant (38)..(38): Xaa in position 38 is Phe, Leu or Val
EXXQXIXXXIKXXXXXXCTXTPFXXXCXXVXLXXXXKXF

SEQ ID NO: 11494 - protein, 31 aa, Artificial sequence
  protein pattern
  Variant (2)..(4): Xaa in position 2 to 4 is any amino acid
  Variant (6)..(6): Xaa in position 6 is any amino acid
  Variant (9)..(9): Xaa in position 9 is any amino acid
  Variant (12)..(12): Xaa in position 12 is any amino acid
  Variant (14)..(14): Xaa in position 14 is Asp, Glu, Gln or Ser
  Variant (15)..(15): Xaa in position 15 is Asp or Glu
  Variant (17)..(17): Xaa in position 17 is any amino acid
  Variant (18)..(18): Xaa in position 18 is Asn or Ser
  Variant (19)..(19): Xaa in position 19 is any amino acid
  Variant (21)..(21): Xaa in position 21 is any amino acid
  Variant (23)..(24): Xaa in position 23 to 24 is any amino acid
  Variant (26)..(26): Xaa in position 26 is Phe or Tyr
  Variant (27)..(27): Xaa in position 27 is Ile or Leu
  Variant (28)..(28): Xaa in position 28 is any amino acid
  Variant (30)..(30): Xaa in position 30 is Ile or Leu
  Variant (31)..(31): Xaa in position 31 is Pro, Gln, Ser or Thr
PXXXPXHEXYYXSXXYXXXPXPXXDXXXVXX

SEQ ID NO: 11495 - protein, 44 aa, Artificial sequence
  protein pattern
  Variant (2)..(2): Xaa in position 2 is any or no amino acid
  Variant (4)..(4): Xaa in position 4 is any amino acid
  Variant (6)..(6): Xaa in position 6 is Glu or Gln
  Variant (7)..(7): Xaa in position 7 is Phe or Tyr
  Variant (8)..(9): Xaa in position 8 to 9 is any amino acid
  Variant (10)..(10): Xaa in position 10 is Asp or Ser
  Variant (11)..(14): Xaa in position 11 to 14 is any amino acid
  Variant (16)..(17): Xaa in position 16 to 17 is any amino acid
  Variant (18)..(18): Xaa in position 18 is any or no amino acid
  Variant (20)..(20): Xaa in position 20 is any amino acid
  Variant (21)..(21): Xaa in position 21 is any or no amino acid
  Variant (23)..(23): Xaa in position 23 is any amino acid
  Variant (24)..(24): Xaa in position 24 is Ala, Ser or Thr
  Variant (25)..(25): Xaa in position 25 is Ala, Pro or Thr
  Variant (26)..(26): Xaa in position 26 is Ile, Leu or Val
  Variant (27)..(27): Xaa in position 27 is any amino acid
  Variant (28)..(28): Xaa in position 28 is Ile or Val
  Variant (30)..(31): Xaa in position 30 to 31 is any amino acid
  Variant (32)..(32): Xaa in position 32 is Asp, Gly or Asn
  Variant (34)..(35): Xaa in position 34 to 35 is any amino acid
  Variant (37)..(37): Xaa in position 37 is Asn, Ser or Thr
KXIXEXXXXXXXXXTXXXIXXLXXXXXXPXXXPXXPXWRLICLP

SEQ ID NO: 11496 - protein, 26 aa, Artificial sequence
  protein pattern
  Variant (2)..(2): Xaa in position 2 is any or no amino acid
  Variant (4)..(4): Xaa in position 4 is any or no amino acid
  Variant (6)..(6): Xaa in position 6 is Ile or Val
  Variant (7)..(7): Xaa in position 7 is Phe or Tyr
  Variant (8)..(8): Xaa in position 8 is Ile or Val
  Variant (9)..(9): Xaa in position 9 is Ser or Thr
  Variant (13)..(13): Xaa in position 13 is any amino acid
  Variant (14)..(14): Xaa in position 14 is Cys or Ser
  Variant (16)..(16): Xaa in position 16 is Ala or Gly
  Variant (17)..(17): Xaa in position 17 is any amino acid
  Variant (19)..(21): Xaa in position 19 to 21 is any amino acid
  Variant (22)..(22): Xaa in position 22 is any or no amino acid
  Variant (24)..(24): Xaa in position 24 is any amino acid
  Variant (26)..(26): Xaa in position 26 is Ile or Leu
WXKXFXXXXNHCXXDXXSXXXXFXDX

SEQ ID NO: 11497 - protein, 28 aa, Artificial sequence
  protein pattern
  Variant (2)..(2): Xaa in position 2 is any amino acid
  Variant (4)..(4): Xaa in position 4 is any amino acid
  Variant (5)..(5): Xaa in position 5 is Leu or Val
  Variant (6)..(6): Xaa in position 6 is Ile, Leu or Met
  Variant (7)..(7): Xaa in position 7 is any amino acid
  Variant (8)..(8): Xaa in position 8 is Asp or Asn
  Variant (9)..(9): Xaa in position 9 is Glu, Arg or Ser
  Variant (10)..(10): Xaa in position 10 is any amino acid
  Variant (11)..(11): Xaa in position 11 is Ile or Leu
  Variant (12)..(14): Xaa in position 12 to 14 is any amino acid
  Variant (18)..(18): Xaa in position 18 is Ala, Thr or Val
  Variant (19)..(19): Xaa in position 19 is Ile or Leu
  Variant (20)..(20): Xaa in position 20 is Ile, Leu or Met
  Variant (23)..(23): Xaa in position 23 is Ala, Thr or Val
  Variant (25)..(25): Xaa in position 25 is any amino acid
  Variant (26)..(26): Xaa in position 26 is Phe or Val
  Variant (27)..(27): Xaa in position 27 is any amino acid
NXDXXXXXXXXXXXRGGXXXSNXGXXXQ

SEQ ID NO: 11498 - protein, 61 aa, Artificial sequence
  protein pattern
  Variant (2)..(7): Xaa in position 2 to 7 is any amino acid
  Variant (8)..(8): Xaa in position 8 is any or no amino acid
  Variant (10)..(14): Xaa in position 10 to 14 is any amino acid
  Variant (15)..(16): Xaa in position 15 to 16 is any or no amino acid
  Variant (20)..(20): Xaa in position 20 is any amino acid
  Variant (23)..(23): Xaa in position 23 is Glu or Thr
  Variant (24)..(25): Xaa in position 24 to 25 is any amino acid
  Variant (26)..(26): Xaa in position 26 is Ile or Val
  Variant (27)..(27): Xaa in position 27 is Asp or Glu
  Variant (28)..(28): Xaa in position 28 is Phe or Tyr
  Variant (29)..(29): Xaa in position 29 is Lys or Arg
  Variant (31)..(31): Xaa in position 31 is Ala or Pro
  Variant (32)..(34): Xaa in position 32 to 34 is any amino acid
  Variant (35)..(35): Xaa in position 35 is Phe, Ile or Leu
  Variant (38)..(38): Xaa in position 38 is any amino acid
  Variant (39)..(39): Xaa in position 39 is Phe, Leu or Met
  Variant (41)..(41): Xaa in position 41 is Ser, Thr or Val
  Variant (42)..(42): Xaa in position 42 is Gly, Ser or Thr
  Variant (44)..(44): Xaa in position 44 is Ile or Leu
  Variant (45)..(45): Xaa in position 45 is any amino acid
  Variant (46)..(46): Xaa in position 46 is Glu, Asn, Ser or Thr
  Variant (47)..(48): Xaa in position 47 to 48 is any amino acid
  Variant (49)..(49): Xaa in position 49 is Asn or Arg
  Variant (51)..(51): Xaa in position 51 is any amino acid
  Variant (52)..(52): Xaa in position 52 is Ser or Thr
  Variant (53)..(53): Xaa in position 53 is any amino acid
  Variant (54)..(54): Xaa in position 54 is Ala, Gly or Ser
  Variant (55)..(59): Xaa in position 55 to 59 is any amino acid
  Variant (60)..(60): Xaa in position 60 is Ala, Asp or Asn
  Variant (61)..(61): Xaa in position 61 is Asp, Glu or Arg
DXXXXXXXDXXXXXXXKLPXPIXXXXXXXPXXXXXPKXXLXXFXXXXXXFXXXXXXXXXXX

SEQ ID NO: 11499 - protein, 12 aa, Artificial sequence
  protein pattern
  Variant (2)..(2): Xaa in position 2 is any or no amino acid
  Variant (4)..(4): Xaa in position 4 is any amino acid
  Variant (5)..(5): Xaa in position 5 is Ala, Ile or Val
  Variant (6)..(6): Xaa in position 6 is any amino acid
  Variant (9)..(9): Xaa in position 9 is Ala or Ile
  Variant (11)..(11): Xaa in position 11 is Gly or Ser
KXYXXXDLXFXQ

SEQ ID NO: 11500 - protein, 15 aa, Artificial sequence
  protein pattern
  Variant (2)..(2): Xaa in position 2 is any amino acid
  Variant (3)..(3): Xaa in position 3 is Asn or Arg
  Variant (4)..(4): Xaa in position 4 is Asp, Asn or Val
  Variant (5)..(5): Xaa in position 5 is any amino acid
  Variant (7)..(8): Xaa in position 7 to 8 is any or no amino acid
  Variant (10)..(10): Xaa in position 10 is any amino acid
  Variant (11)..(11): Xaa in position 11 is any or no amino acid
  Variant (13)..(13): Xaa in position 13 is Glu or Ser
  Variant (14)..(14): Xaa in position 14 is Phe or Leu
TXXXXGXXEXXEXXC

SEQ ID NO: 11501 - DNA, 1122 bp, Saccharomyces cerevisiae
  CDS (1)..(1122)
atgacagtgaatgacaaaaaaagattggcaatcataggtggggggccaggagggttggcagctgcaagagttttctcgcaaagtcttccaaattttgaaatagaaatatttgtaaaggattacgatattggcggtgtctggcattatccagaacaaaaaagtgatgggagggtcatgtatgaccatttggaaaccaatatatcaaagaagttaatgcagtttagcggctttcccttcgaggaaaacgtccctttatatccgtctcgaagaaacatttgggaatacttgaaagcctattacaaaacgttcattgccaacaaagatgctatcagcatccatttcagcaccgaagttacctacttaaagaagaagaactctcaatgggagataacatctaaagacgaactaaggactactaaatcggattttgacttcgttattgttgcgtctggtcactacagtgtccctaaactaccaactaatatcgcaggtctcgatctatggttcgacaataagggcgcctttcattctaaggatttcaaaaactgcgagtttgcccgtgaaaaagtcgttattgtggtgggaaacggcagttccggccaagatattgccaaccaactaactaccgttgcaaagaaagtatataatagtataaaagagcctgcgagcaatcaactgaaggccaagttaatcgagactgtccaaacaatagacagtgccgattggaaaaatcgttcagttactttatctgatggaagagtacttcagaatatagactacattattttcgccacaggctattattacagctttccatttatagagccctccgttagactggaagtgctaggtgagggtgttactggcgacaagcactcgtctgtcaatctgcacaatttgtgggagcacatgatctatgtaaaagatcctacgctgtcctttatcttgaccccgcagttggtcatcccgttcccgttgtcggaactacaggcggctattatggtcgaagtattctgtaaaagcttaccgataactacaactttcgactctaatgcctgcggaacgcacaacttcccaaaggaaaggacctggaatactatgcagaactacaggaactactga

SEQ ID NO: 11502 - protein, 373 aa, Saccharomyces cerevisiae
MTVNDKKRLAIIGGGPGGLAAARVFSQSLPNFEIEIFVKDYDIGGVWHYPEQKSDGRVMYDHLETNISKKLMQFSGFPFEENVPLYPSRRNIWEYLKAYYKTFIANKDAISIHFSTEVTYLKKKNSQWEITSKDELRTTKSDFDFVIVASGHYSVPKLPTNIAGLDLWFDNKGAFHSKDFKNCEFAREKVVIVVGNGSSGQDIANQLTTVAKKVYNSIKEPASNQLKAKLIETVQTIDSADWKNRSVTLSDGRVLQNIDYIIFATGYYYSFPFIEPSVRLEVLGEGVTGDKHSSVNLHNLWEHMIYVKDPTLSFILTPQLVIPFPLSELQAAIMVEVFCKSLPITTTFDSNACGTHNFPKERTWNTMQNYRNY

SEQ ID NO: 11503 - DNA, 1386 bp, Glycine max
  CDS (1)..(1386)
atggtttccgaaacaaaccagtccaagaatgtgtgtgtaattggagctggaccatcagggctagtggcagcgagggagctgaaaagagaaggtcataaggtggttgtgttggagcagaaccatgatattggaggtcaatggctatataacccaaatgtacaagaggaggaccctttgggaagagacccttggctaaaggtgcatagcagcatctatgagtctttaaggctcatgtcccccagagaggtcatgggcttcactgatttcccctttttagtcaagaaaggtagagatccaaggaggtttcctagtcatagagagctccttctctaccttaaggacttttgtgaatggtttgagttgagagacatgatcaagttcaatacaaaggtgcattatgtgggaccattaaattatggtgtccctagtgaggatttgaaatgggttgttagaagcaaagacaagaacagcgaggaggaagttgaacaagtgtttgacgctgtggttgttgccactggccattactctaaccccagattgccatgcattcaaggaatggccatatggaaaaggaaacaaatgcacagtcacatttacaggtcgccagagccattccgtggggagatagtggtggtggttggaaattcttttagtggacaagaaatatcaatggaacttgtgaaagtagtgaaggaactccacctcagttcaaaatcacttgacatttatgagggtttatctaaagtcatatccaaacacgagaactttcatcttcgtccacagatagagacccttcgagaggatgggacggtcattttcaacgatggctccagcattatcgcagacactattttatactgcactgggtacacctattccttcccctttcttgacaccaaaggaatggttgttgtggatgataacagagtgggtcctttgtatgaacacacgttccccccagcacttgctccttctctttctcttgtaggcatccccagaagaatcctggggctccctttctttgagtcgcaaggaaaatgggtagctcaactgctttctgggaaaaaggctttgccatcatatgaggaaatgatgaaatcgatcaaggagttttatcattcaaaagaagaagctggcattcctaaacattatacccatgaaattgaaggctttgattattgtgataaatacgcagaaaatgtaggactcccaaagttacaagaatggaggaaagatctgtgtgtatcagctgtagtgaacttatttatcaacttggagacatatcgtgattcgtggaatgatgatattgatgagaagcttcaagaagcccttcgaagtccttacttcactcaactaggagttgaacctgaagatccttctctgtaa

SEQ ID NO: 11504 - protein, 461 aa, Glycine max
MVSETNQSKNVCVIGAGPSGLVAARELKREGHKVVVLEQNHDIGGQWLYNPNVQEEDPLGRDPWLKVHSSIYESLRLMSPREVMGFTDFPFLVKKGRDPRRFPSHRELLLYLKDFCEWFELRDMIKFNTKVHYVGPLNYGVPSEDLKWVVRSKDKNSEEEVEQVFDAVVVATGHYSNPRLPCIQGMAIWKRKQMHSHIYRSPEPFRGEIVVVVGNSFSGQEISMELVKVVKELHLSSKSLDIYEGLSKVISKHENFHLRPQIETLREDGTVIFNDGSSIIADTILYCTGYTYSFPFLDTKGMVVVDDNRVGPLYEHTFPPALAPSLSLVGIPRRILGLPFFESQGKWVAQLLSGKKALPSYEEMMKSIKEFYHSKEEAGIPKHYTHEIEGFDYCDKYAENVGLPKLQEWRKDLCVSAVVNLFINLETYRDSWNDDIDEKLQEALRSPYFTQLGVEPEDPSL

SEQ ID NO: 11505 - DNA, 1380 bp, Glycine max
  CDS (1)..(1380)
atggtttctgagacactccaaagccaaaccaagaacgtgtgcgtgattggagcaggaccatcagggctagtggcagcaagagagttgagaaaagagggtcacagggtggttttgttggagcagaatcatgatgttggaggacagtggctatatgaatcaaatgtggaaggagaggaccctttagggaaaaagccttttctaaaggttcatagcagcatctatgaatctttgaggctcacatctccacgtgagatcatggggttcactgatttcccttttttggtcaagaagggtagagacatgaggaggttccctagccacacagagctgcttatgtacttaagggacttttgtgaacattttggcttgggagagatgataaggttcaacacaagggtggattatgtgggaatgttggattatggtgtctgtagtaatgatttgaagtgggttgttagaagtgaagataagaagagtgaaaagacggtggaagaggtgtttgatgcagttgttgttgccactggtcattactctcaaccaagattgccctccattcaaggaatggatacatggaaaaggaaacaaatgcacagtcacatttacaggaccccagaaccattccgcaatgagattgtagtggtggttggaaattccttgagcgggcaagacatatcaatagagcttgtggatgtagcaaaggaagtccatatgagttccagatctcttaacatctctgagggtttgtctaaagtcatatccaaacatgccaactttcatcttcatccacagatagagacccttcaagaggatggacgggtaacattcgtggatggttcttccattttggcagactccattttgtactgtacagggtactcctatgcattcccctttcttgacaccaaagaaatggtggttgtagatgatgacagagtggggccattgtatgagcacacttttcccccatcacttgctccatccctttcttttataggcatccctagaaagatcatagggttccctttctttgagtcacaagcaatatggatagctcaactgctttccgggaaaaaagtattgccatcatgggaggaaatgatgaaatccatcaaggaattctaccaatcaagagaagcagcaggcattcccaagcactgtactcatgaaattgcaaactttgggtactgtgacaaatacggggataatgtggggttcccacgtatagaagaatggaggaaacagctatgcctatcagccttaattaactctgatgccaacttggagacatatcgagattcatgggacgatcatgagctgctccaagaggccctccagagcccacacttcactcaacttggacttgaagattctcccatgtaa

SEQ ID NO: 11506 - protein, 459 aa, Glycine max
MVSETLQSQTKNVCVIGAGPSGLVAARELRKEGHRVVLLEQNHDVGGQWLYESNVEGEDPLGKKPFLKVHSSIYESLRLTSPREIMGFTDFPFLVKKGRDMRRFPSHTELLMYLRDFCEHFGLGEMIRFNTRVDYVGMLDYGVCSNDLKWVVRSEDKKSEKTVEEVFDAVVVATGHYSQPRLPSIQGMDTWKRKQMHSHIYRTPEPFRNEIVVVVGNSLSGQDISIELVDVAKEVHMSSRSLNISEGLSKVISKHANFHLHPQIETLQEDGRVTFVDGSSILADSILYCTGYSYAFPFLDTKEMVVVDDDRVGPLYEHTFPPSLAPSLSFIGIPRKIIGFPFFESQAIWIAQLLSGKKVLPSWEEMMKSIKEFYQSREAAGIPKHCTHEIANFGYCDKYGDNVGFPRIEEWRKQLCLSALINSDANLETYRDSWDDHELLQEALQSPHFTQLGLEDSPM

SEQ ID NO: 11507 - DNA, 1374 bp, Arabidopsis thaliana
  CDS (1)..(1374)
atggcaccagcacgaacccgagtcaactcactcaacgtggcagtgatcggagccggagccgccggactcgtagctgcaagagagctccgccgcgagaatcacaccgtcgtcgttttcgaacgtgactcaaaagtcggaggtctctgggtatacacacctaacagcgaaccagacccgcttagcctcgatccaaaccgaaccatcgtccattcaagcgtctatgattctctccgaaccaatctcccacgagagtgcatgggttacagagacttccccttcgtgcctcgacctgaagatgacgaatcaagagactcgagaaggtaccctagtcacagagaagttcttgcttaccttgaagacttcgctagagaattcaaacttgtggagatggttcgatttaagaccgaagtagttcttgtcgagcctgaagataagaaatggagggttcaatccaaaaattcagatgggatctccaaagatgagatctttgatgctgttgttgtttgtaatggacattatacagaacctagagttgctcatgttcctgattcatggccagggaagcagattcatagccacaattaccgtgttcctgatcaattcaaagaccaggtggtggtagtgataggaaattttgcgagtggagctgatatcagcagggacataacgggagtggctaaagaagtccatatcgcgtctagatcgaatccatctaagacatactcaaaacttcccgggtcaaacaatctatggcttcactctatgatagaaagtgtacacgaagatgggacgattgtttttcagaacggtaaggttgtacaagctgataccattgtgcattgcactggttacaaatatcacttcccatttctcaacaccaatggctatattactgttgaggataactgtgttggaccgctttacgaacatgtctttccgcctgcgcttgctcccgggctttccttcatcggtttaccctggatgacactgcaattctttatgtttgagctccaaagcaagtgggtggctgcagctttgtctggccgggtcacacttccttcagaagagaaaatgatggaagacgttaccgcctactatgcaaagcgtgaggctttcgggcaacctaagagatacacacatcgacttggtggaggtcaggttgattaccttaattggatagcagagcaaattggtgcaccgcccggtgaacaatggagatatcaggaaataaatggcggatactacagacttgctacacaatcagacactttccgtgataagtgggacgatgatcatctcatagttgaggcttatgaggatttcttgagacagaagctgattagtagtcttccttctcagttattggaatcttga

SEQ ID NO: 11508 - protein, 457 aa, Arabidopsis thaliana
MAPARTRVNSLNVAVIGAGAAGLVAARELRRENHTVVVFERDSKVGGLWVYTPNSEPDPLSLDPNRTIVHSSVYDSLRTNLPRECMGYRDFPFVPRPEDDESRDSRRYPSHREVLAYLEDFAREFKLVEMVRFKTEVVLVEPEDKKWRVQSKNSDGISKDEIFDAVVVCNGHYTEPRVAHVPDSWPGKQIHSHNYRVPDQFKDQVVVVIGNFASGADISRDITGVAKEVHIASRSNPSKTYSKLPGSNNLWLHSMIESVHEDGTIVFQNGKVVQADTIVHCTGYKYHFPFLNTNGYITVEDNCVGPLYEHVFPPALAPGLSFIGLPWMTLQFFMFELQSKWVAAALSGRVTLPSEEKMMEDVTAYYAKREAFGQPKRYTHRLGGGQVDYLNWIAEQIGAPPGEQWRYQEINGGYYRLATQSDTFRDKWDDDHLIVEAYEDFLRQKLISSLPSQLLES

SEQ ID NO: 11509 - DNA, 1380 bp, Arabidopsis thaliana
  CDS (1)..(1380)
atggcaccagcacgaacccgagtcaactcactcaacgtggcagtgatcggagccggagccgccggactcgtagctgcaagagagctccgccgcgagaatcacaccgtcgtcgttttcgaacgtgactcaaaagtcggaggtctctgggtatacacacctaacagcgaaccagacccgcttagcctcgatccaaaccgaaccatcgtccattcaagcgtctatgattctctccgaaccaatctcccacgagagtgcatgggttacagagacttccccttcgtgcctcgacctgaagatgacgaatcaagagactcgagaaggtaccctagtcacagagaagttcttgcttaccttgaagacttcgctagagaattcaaacttgtggagatggttcgatttaagaccgaagtagttcttgtcgagcctgaagataagaaatggagggttcaatccaaaaattcagatgggatctccaaagatgagatctttgatgctgttgttgtttgtaatggacattatacagaacctagagttgctcatgttcctggtatagattcatggccagggaagcagattcatagccacaattaccgtgttcctgatcaattcaaagaccaggtggtggtagtgataggaaattttgcgagtggagctgatatcagcagggacataacgggagtggctaaagaagtccatatcgcgtctagatcgaatccatctaagacatactcaaaacttcccgggtcaaacaatctatggcttcactctatgatagaaagtgtacacgaagatgggacgattgtttttcagaacggtaaggttgtacaagctgataccattgtgcattgcactggttacaaatatcacttcccatttctcaacaccaatggctatattactgttgaggataactgtgttggaccgctttacgaacatgtctttccgcctgcgcttgctcccgggctttccttcatcggtttaccctggatgacactgcaattctttatgtttgagctccaaagcaagtgggtggctgcagctttgtctggccgggtcacacttccttcagaagagaaaatgatggaagacgttaccgcctactatgcaaagcgtgaggctttcgggcaacctaagagatacacacatcgacttggtggaggtcaggttgattaccttaattggatagcagagcaaattggtgcaccgcccggtgaacaatggagatatcaggaaataaatggcggatactacagacttgctacacaatcagacactttccgtgataagtgggacgatgatcatctcatagttgaggcttatgaggatttcttgagacagaagctgattagtagtcttccttctcagttattggaatcttga

SEQ ID NO: 11510 - protein, 459 aa, Arabidopsis thaliana
MAPARTRVNSLNVAVIGAGAAGLVAARELRRENHTVVVFERDSKVGGLWVYTPNSEPDPLSLDPNRTIVHSSVYDSLRTNLPRECMGYRDFPFVPRPEDDESRDSRRYPSHREVLAYLEDFAREFKLVEMVRFKTEVVLVEPEDKKWRVQSKNSDGISKDEIFDAVVVCNGHYTEPRVAHVPGIDSWPGKQIHSHNYRVPDQFKDQVVVVIGNFASGADISRDITGVAKEVHIASRSNPSKTYSKLPGSNNLWLHSMIESVHEDGTIVFQNGKVVQADTIVHCTGYKYHFPFLNTNGYITVEDNCVGPLYEHVFPPALAPGLSFIGLPWMTLQFFMFELQSKWVAAALSGRVTLPSEEKMMEDVTAYYAKREAFGQPKRYTHRLGGGQVDYLNWIAEQIGAPPGEQWRYQEINGGYYRLATQSDTFRDKWDDDHLIVEAYEDFLRQKLISSLPSQLLES

SEQ ID NO: 11511 - DNA, 1383 bp, Arabidopsis thaliana
  CDS (1)..(1383)
atggttacgttcacatcagaagcatcaaggagccgatcaaagaaggtatgtgtgatcggagctggaccggcggggttagtctcggcaagggagctaagaaaagaaggacacaaagtggtggtgttggagcaaaacgaagacgtaggaggtcaatggttctatcaaccaaacgtagaagaagaagatcccttaggaagaagtagtggttccattaatggtgaactgaaggtccatagcagcatttactcttccttgaggctaacctcaccgagagagataatgggttattcggattttccgtttttggcgaagaaagggagagatatgaggaggtttccagggcataaggagctttggttgtatcttaaggactttagtgaagcttttgggttaagagagatgattaggtttaatgttagggttgagtttgtaggagaaaaagaagaagaggatgatgtgaagaagtggattgtgagaagtagagagaaatttagtggtaaggttatggaagagatctttgatgctgttgttgttgctactggtcattactctcaccctagattgccctctattaaaggaatggattcttggaaaaggaagcaaattcatagccatgtttacagggtgcctgatccatttcgtaatgaggtggtggtggtggttgggaactcaatgagtggacaagacatatcaatggagcttgtggaagtggcaaaggaagttcatttaagtgccaagacacttgatatatcttctggcctttcaaaagtcatttccaaacacccaaaccttcttattcacccacagattgaatctttagaggatgatgggaaagtcatttttgtggatggttcttgggtcgtcgctgatacaattttatattgcaccgggtactcgtacaagtttccatttcttgagagtaaaggaagaatagaagtggatgatgatagagttggtccactcttcgaacacactttccctccttgtctctccccttctctctcctttgtcggtatccccagaaagttgataggattcccattctttgaagcacaagcaaaatggatagcacaagttttgtcaggaaagtcatctcttccttctcctgaccaaatgttacaatcagtagacgagttttaccggtcaagagatctagccggagtccctaaacacaacactcacgacattgccgatttcacgtattgcgataagtacgcggattatgttgggtttccgcatttagaagattggagaaagctactatgtttgtctgctctcaataattcacaagaaaatcttgagacttatcgcgattcttgggatgatcatgaactcctacaagaagctcttcaaagctctcatttcacaaacttcaattcttga

SEQ ID NO: 11512 - protein, 460 aa, Arabidopsis thaliana
MVTFTSEASRSRSKKVCVIGAGPAGLVSARELRKEGHKVVVLEQNEDVGGQWFYQPNVEEEDPLGRSSGSINGELKVHSSIYSSLRLTSPREIMGYSDFPFLAKKGRDMRRFPGHKELWLYLKDFSEAFGLREMIRFNVRVEFVGEKEEEDDVKKWIVRSREKFSGKVMEEIFDAVVVATGHYSHPRLPSIKGMDSWKRKQIHSHVYRVPDPFRNEVVVVVGNSMSGQDISMELVEVAKEVHLSAKTLDISSGLSKVISKHPNLLIHPQIESLEDDGKVIFVDGSWVVADTILYCTGYSYKFPFLESKGRIEVDDDRVGPLFEHTFPPCLSPSLSFVGIPRKLIGFPFFEAQAKWIAQVLSGKSSLPSPDQMLQSVDEFYRSRDLAGVPKHNTHDIADFTYCDKYADYVGFPHLEDWRKLLCLSALNNSQENLETYRDSWDDHELLQEALQSSHFTNFNS

SEQ ID NO: 11513 - DNA, 1386 bp, Arabidopsis thaliana
  CDS (1)..(1386)
atggtgttagtgattacagagccaattaagagtcaatcaaagacggtatgtgtgataggagcaggaccatcagggttagtgtcggcgcgagagctaaagaaagaaggacataaagtggtggtgatggagcaaaaccacgacgtaggaggtcagtggttataccaaccaaacgtagatgaagaagatacattgggaaaaaccaaaaccctaaaagtacatagcagtgtttactcatccttgaggttagcttcacccagagaggtaatgggtttctctgatttccccttcatcgcgaaggaaggaagagactcgaggagattcccagggcatgaggagcttttgttgtatcttaaggatttttgtcaagtgtttgggttaagagagatgattaggtttaatgttagggttgagtttgtgggaatggtgaatgaagatgatgatgatgatgatgatgtgaagaaatggatggtgaagagtgtaaagaaaagtggtgaggttatggaagaagtgtttgatgctgttgttgttgcctctggccattactcttatcctagattgcctacaattaaaggtatggatttgtggaagaggaagcaacttcatagccatatatatagagtgcctgagcctttttgtgatgaggtagtggtggtcgttggatgctcaatgagtggacaagacatatcaatagagcttgtggaagtggcaaaggaagttcatctaagtaccaaatcacttgatattcctcctggcttgtccaaagtcattgaaaaacatcaaaatctccatcttcatcctcagattgaatctctggaagaagatggacgggtcattttcgaagatgggtcttgcattgtagccgacactattttatactgtaccgggtatgagtacaaatttccatttcttgagagcaaaggaagagtagagattgatgataatagagttggaccactcttcgaacatactttctctccttctctatccccttttctctcctttgtcggaatccctcgaaagttgatagggttcccattctttgaatcacaagctaaatggattgcaaagcttttgtcaggcaaaacttcacttccttcctctgatcaaatgatgcaatcaatctctgatttctatctcgccagagaagctgacggaatccctaaacgtaacactcacgacatcgccgatttcaattatagcgataaatacgcggattacatcggatttccacatctggaggaatggagaaaggtcttgtgtttatcggctatattgaattccatcgaaaatctagagacttatcgtgactcttgggacgatgatgatcttcttcaagaaactcttcaagacccttactttacccaactttcaattccttctgtttga

SEQ ID NO: 11514 - protein, 461 aa, Arabidopsis thaliana
MVLVITEPIKSQSKTVCVIGAGPSGLVSARELKKEGHKVVVMEQNHDVGGQWLYQPNVDEEDTLGKTKTLKVHSSVYSSLRLASPREVMGFSDFPFIAKEGRDSRRFPGHEELLLYLKDFCQVFGLREMIRFNVRVEFVGMVNEDDDDDDDVKKWMVKSVKKSGEVMEEVFDAVVVASGHYSYPRLPTIKGMDLWKRKQLHSHIYRVPEPFCDEVVVVVGCSMSGQDISIELVEVAKEVHLSTKSLDIPPGLSKVIEKHQNLHLHPQIESLEEDGRVIFEDGSCIVADTILYCTGYEYKFPFLESKGRVEIDDNRVGPLFEHTFSPSLSPFLSFVGIPRKLIGFPFFESQAKWIAKLLSGKTSLPSSDQMMQSISDFYLAREADGIPKRNTHDIADFNYSDKYADYIGFPHLEEWRKVLCLSAILNSIENLETYRDSWDDDDLLQETLQDPYFTQLSIPSV

SEQ ID NO: 11515 - DNA, 1410 bp, Magnaporthe grisea 70-15
  CDS (1)..(1410)
atggtcctccgagcctgcttcgatgtgaagcgcatcgccgtcatcggcgctggcccctgtggcctcgctgctgccaaatacctcgtggcgcaaaaggccttttccgaaatcgttgtctttgagcaggcagcagaagtcggcggggtttggaattacagcaagactccctcgagcacgctgcacgttcctcagacgaaccccttgtgcgcgccggatcccccagtctttcccgacaaggagggaccggctatgtttccgtcgcccatgtatgatctcttgcataccaacattccaagaactataatgggatttaaagacttggaattgtctgccggtgtggcttttccccatcgggatgaggttcaggcttatttggtgaagtactcgcaagacgttcgacatcttatcaaattctctaccattgtcaaagacgttcgtctcaggcaagggacagaaattgatcaatgggatgtcagaaccgagtcctctacgggtggtaatccacagatgcagacctttgacgctgttgtggttgcatctggtcactactccacgacttatatgccccggatccccaacattgaggactttcacaaaacgcacccagccgtcattacacactcaaagacctaccgctcgcccagtatctacacgggcaagaaggtcattgttgtgggcaactcagcctcaggagttgacattgcagcgcagatccagagggtggctgggaaggtgttcctctcggtgcgggaggcgacagcgtcggatagcttagcccacattggggctgaagaaacacctccaatctcagagtttctggtgaaggaaaagggggtgcagttcgaagacggccgggttgagaaggacattgattccgtggtgttttgcactgggtatctttttgccttcccctttttggagtcgcttgctaccccgctgttgacagacggccgtcgtgtccacggactatacaaggacttcctgcacatcaagcatcctacattggtgttcccgggtcttccgatcaaggttattccgttcccattctcggaaagccaggctgcaatctacgcgcggctctgggcgaacgccttgccgctgccatccgagaaggaaatgtccgactgggaaaagagcgcggaagagcagagaggcccggcgtttcacgtctacccaaagaagggcgatgtcgagtatctcagggagatgcacgcctgggcttcaaaggccgagagtggaaaggagcctccgctatggaccgatgaacaagtttggcagagggaaatctacgcgcaagccaagctagagtttgaaaagactggcaggaccgccaagaccctcgctgaactcggcttccattacaaggcgccgtctgacgtagtggaggaagccgctcaggatgttctatga

SEQ ID NO: 11516 - protein, 469 aa, Magnaporthe grisea 70-15
MVLRACFDVKRIAVIGAGPCGLAAAKYLVAQKAFSEIVVFEQAAEVGGVWNYSKTPSSTLHVPQTNPLCAPDPPVFPDKEGPAMFPSPMYDLLHTNIPRTIMGFKDLELSAGVAFPHRDEVQAYLVKYSQDVRHLIKFSTIVKDVRLRQGTEIDQWDVRTESSTGGNPQMQTFDAVVVASGHYSTTYMPRIPNIEDFHKTHPAVITHSKTYRSPSIYTGKKVIVVGNSASGVDIAAQIQRVAGKVFLSVREATASDSLAHIGAEETPPISEFLVKEKGVQFEDGRVEKDIDSVVFCTGYLFAFPFLESLATPLLTDGRRVHGLYKDFLHIKHPTLVFPGLPIKVIPFPFSESQAAIYARLWANALPLPSEKEMSDWEKSAEEQRGPAFHVYPKKGDVEYLREMHAWASKAESGKEPPLWTDEQVWQREIYAQAKLEFEKTGRTAKTLAELGFHYKAPSDVVEEAAQDVL

SEQ ID NO: 11517 - DNA, 1470 bp, Gibberella zeae PH-1
  CDS (1)..(1470)
atggctctggcagataaactcgacgttcgtcgcattgccatcataggtgctggccctagtggccttgcagctgccaaatatcttctcgcagaaaagaagttctccaaagttcgtatcttcgagcaacgtgccacagcaggcggcgtatggaattacactcctctagcccgcgagcagggcttctcagttcctaggactcaacctagttatgcggcagatcaagccctttggcctaacgatcatggggatgttgaattcatgtctcctatttacgatcttcttgaaacaaacattccgcattcgctcatgaggtacagcgacaaagaatttcccaagggttcttctttgtttcctcgtcatagcgttgtgctgcagtacctcaaagactacgcccaagagatcactcctcacatttcatttcagactcaggttttgaatattgataagccgaggtcagatcactcacaatcgtggtcagttgaggtgcttgacctgaagtccaacaaggtcatcaaagaagaatatgacgctgttgtggtggcgagtggacattacaacgatcctttcatccctgatataaccggcctcaccgagtttgataagaaatactcgggtgtcatttcgcattccaagttctatagaagacccaatgacttcaaggacaagaaagtcattgttgttggcaactctgcatctggtgtcgatgtgagcgcgcaactttctaatgttgcaaagcaccccatcttcatctcagaaaaggaaaagtcgacagtggtagcccctacaaaagagccatgggcagccggcgttcccgaaatagtcgagttcctccccgagcagcgcggtgtccgctttgccaacggccaagtcgagaatgacattgatgctgtgatattctgtactggattccactattcgtaccccttcctcaagtctctcgatcctcccgtggttgttcccagtggcggacacgcagcgcatctatgggaacacattctctacactgcagacccaactctctcattccttagtgtcccgcaacgaattgtccctttccccgtcgccgaggcacagagcgctgtgattgcccgcatatggtctggtcgtctgagccctccatctgaagccatgatggaagcatgggtggaagagcagcacgaaaagaaaggagaaggcaaggctattcatgtcatggctttccctgaagacgtcgactacgtcaatcgcttacatgggctaagcaaggcagcaccaagagctcctgaactgggtctcgagaatgaaggacaaggcaagttgcctccatactggggacttgacaagaggtgggtgcgagagagagtgccaaagatcaagctggcaagcagagcagcgggcgagaagaggcacgagctgaggagattggaagaccttggtttcgattatgaggagtggaagaggactgtcgaggaaggtgaaaggctcttctaa

SEQ ID NO: 11518 - protein, 489 aa, Gibberella zeae PH-1
MALADKLDVRRIAIIGAGPSGLAAAKYLLAEKKFSKVRIFEQRATAGGVWNYTPLAREQGFSVPRTQPSYAADQALWPNDHGDVEFMSPIYDLLETNIPHSLMRYSDKEFPKGSSLFPRHSVVLQYLKDYAQEITPHISFQTQVLNIDKPRSDHSQSWSVEVLDLKSNKVIKEEYDAVVVASGHYNDPFIPDITGLTEFDKKYSGVISHSKFYRRPNDFKDKKVIVVGNSASGVDVSAQLSNVAKHPIFISEKEKSTVVAPTKEPWAAGVPEIVEFLPEQRGVRFANGQVENDIDAVIFCTGFHYSYPFLKSLDPPVVVPSGGHAAHLWEHILYTADPTLSFLSVPQRIVPFPVAEAQSAVIARIWSGRLSPPSEAMMEAWVEEQHEKKGEGKAIHVMAFPEDVDYVNRLHGLSKAAPRAPELGLENEGQGKLPPYWGLDKRWVRERVPKIKLASRAAGEKRHELRRLEDLGFDYEEWKRTVEEGERLF

SEQ ID NO: 11519 - DNA, 1413 bp, Gibberella zeae PH-1
  CDS (1)..(1413)
atgggctctctgactcagtcttcgtctttcgacgtcaacaaagtcgccatcatcggtgcaggtccaacagggattgctgctgcgaaatacctcatagcgcaaggcatccgcgatatcaccatttttgaacaacaagaccatgttggtggcatttggcattaccatggcttcgctgctggaacttgtcccgttcctcaggaggatccctaccatcctccagatgagcctctcaagtgggattcgacatcaccaccaatatttacatcgccaatgtacgaaaaccttcacgctaacatcccgaaggaagtcatgaacttttccgatcagccttttcccgaggacgccaaactgttccccgagaggcccatgattgaagattatctgatcaaatattccgaggacattaagcctctgatacaattctgtcagcgtgttgaaagggtgtcgttgaagcaacaagatggtcgggataagtgggaggtggaggcaaaatccaccatgactggtaacgacggcatcacgcaagccttcgatgccgttgttgtaggaaacggtcattactcaacgccttttgtgcccgatatgcggaacataaaagagtttaacgaagcgtaccccggagtcatcacccactctaaacagtatcgaacgccctgcacattcaaggaccgcaaggtagttgtggtgggtaacggtccatctggtttagacattgctcttcagatcaatcaagagtgcaggaaacccgcttttttatctgtgaggcatcctacacctccagaccgactgcatcactgtggatgcgaagaaatggctgaaatcgacgagttcatggttgagcagaagggtcttcgtttcaaagatggccgggtcgagacagacattgatgccgttatcttctgtactgggttcctttatagttacccgtttctccaggatctagaccacaaactcgttactacaggtcgaggcgtccgcggtttgtatcaacatgtttttgatatcaggcatcctaccctcgttttccctggtctcaacatgaaggctgccccatggccactggccgagagtcaggccgctctcttcgcagcggtatggtccaacaatctcgagcttccgtcacgaggagtcatggaagcttggaatatggaactagagaagcgagaaggagaggctttgcacatgtttggtcctaatggggacggactctacatcaacgagttgcatgattgggtcatgacagctaagcggcctggaaaggagccgcctcactgggatcgtgagctgatgtggcagcgtagcgttttcattgacgccaaggtaaaatttgagcaactgggctgcaaagcacgaaccatgaaggaggttggattttgctatgaacctgataacacccagacaagtaccgcgtga

SEQ ID NO: 11520 - protein, 470 aa, Gibberella zeae PH-1
MGSLTQSSSFDVNKVAIIGAGPTGIAAAKYLIAQGIRDITIFEQQDHVGGIWHYHGFAAGTCPVPQEDPYHPPDEPLKWDSTSPPIFTSPMYENLHANIPKEVMNFSDQPFPEDAKLFPERPMIEDYLIKYSEDIKPLIQFCQRVERVSLKQQDGRDKWEVEAKSTMTGNDGITQAFDAVVVGNGHYSTPFVPDMRNIKEFNEAYPGVITHSKQYRTPCTFKDRKVVVVGNGPSGLDIALQINQECRKPAFLSVRHPTPPDRLHHCGCEEMAEIDEFMVEQKGLRFKDGRVETDIDAVIFCTGFLYSYPFLQDLDHKLVTTGRGVRGLYQHVFDIRHPTLVFPGLNMKAAPWPLAESQAALFAAVWSNNLELPSRGVMEAWNMELEKREGEALHMFGPNGDGLYINELHDWVMTAKRPGKEPPHWDRELMWQRSVFIDAKVKFEQLGCKARTMKEVGFCYEPDNTQTSTA

SEQ ID NO: 11521 - DNA, 1296 bp, Candida glabrata CBS 138
  CDS (1)..(1296)
atgaccaagaatcagaagactgtgtgtataattggcggtggacctggtgggttggctgctgcaagagtgttatctaaggacttccctgaagctaagattacgttgatcgagaaagaagaggatgttggtggtgtatggtattatcccgagaataataaagaaggtagagtcatgtatgattaccttgagaccaatttatctaaggacctgatgaaattcagtggctttcccttcaaggatgatgtccctttttaccctagaaagaatcaagtgttcgattacttaaaggaatattatcaaacgtacatcaaaaaccactctaatgttgacattgagcttgagaccgaggtgattaacgttgataagaagtctgataagtggattgttaccacgaaacacgccaattcagagacagtaagggaattagattttgtcattgtctcaaatggtcactttaaagaaccaaaataccctaaggatgtctttgggttagattcatggctatccaatggtaaagccttccactcaaaggatttctacaattgtgaatttgccaaggacaaaaaaattattgttgtaggtaatggaagttcaggttcagatattgccaaccagattagtacagtggctgccaaagtatatgtgagtgtcacaaatgtggaagatttcaaggataagaataatgaccccgagtttatagtagaatacattccaaagatcaagagtgttggtggtgacgattcctctgttaaattggaggatggcagagtcatagagaacatcgactatatcatatatgcaaccggatacttgtattcccttccattttttgctagccacatctctgagaagcttctgaagcaagatcaatctggtatcactaacttgtgggaacaatgtgtatacaaggaggaccctacactaggattcctgctgctttcgataatggttgtccctttcccactcgccgaatcacaatccaccatcctttctcaggtattccaaggcaacattgatatcgctactgtaactcctagtagagacgaagttgaacacgagaaaaactacggccataatttcccaaagttgtcggatattgatttctaccgtgaactacaagatatactggacaagcatggttcaaacacattcaaaccagtagtatgggatgaagtctacgaaaagaaaagaaaggaatccgcagaggtcaagcaacaaagaaatgaatacttggcaaagcacgctcaaaagctacacaaggagaaccgtccatactatttacctgataatttctag

SEQ ID NO: 11522 - protein, 431 aa, Candida glabrata CBS 138
MTKNQKTVCIIGGGPGGLAAARVLSKDFPEAKITLIEKEEDVGGVWYYPENNKEGRVMYDYLETNLSKDLMKFSGFPFKDDVPFYPRKNQVFDYLKEYYQTYIKNHSNVDIELETEVINVDKKSDKWIVTTKHANSETVRELDFVIVSNGHFKEPKYPKDVFGLDSWLSNGKAFHSKDFYNCEFAKDKKIIVVGNGSSGSDIANQISTVAAKVYVSVTNVEDFKDKNNDPEFIVEYIPKIKSVGGDDSSVKLEDGRVIENIDYIIYATGYLYSLPFFASHISEKLLKQDQSGITNLWEQCVYKEDPTLGFLLLSIMVVPFPLAESQSTILSQVFQGNIDIATVTPSRDEVEHEKNYGHNFPKLSDIDFYRELQDILDKHGSNTFKPVVWDEVYEKKRKESAEVKQQRNEYLAKHAQKLHKENRPYYLPDNF

SEQ ID NO: 11523 - DNA, 1272 bp, Kluyveromyces lactis NRRL Y-1140
  CDS (1)..(1272)
atggtttcaattggtatcatcggtgctggacctgccggtatcgctgctgctagagttctgattgcaaatgatagatcgtatgatatagatctgttcgaaactagttccaaaatcggcggtgtttggaactacgacccccaatctaataatactgcaatgtacgatgtgctagaaaccaatttatccagccatctaatggcttttaaagattacccatttactaatatcgatccgaatattaagacattccctggaagagaacaagttcaacagtatttggaatcctattacgattcaacggttgccaattactcaaaattgggacttttcaccgaaaagagggtcatttcattggagaaagtggactcacattgggaactgaaagctgattccgatgattctacttacatttacgattacatcgtggtagctaatggccatttcaacaaaccgttcattccaacagtacctggatcataccaatggaaaaaccagtctcattccaagaatttcgtcaactctgaacactacaggggactaaacgtagttgtagtaggtaacgcaagttcagcgaccgacatcgcgacccagatcagtaccactgcctcgaaagtttaccatagtgtgaaaccagattccgaaaccaattggccagcaaatagcatcattgaagtcgtatcacagatccaatccttagatgaacccaattcgaacacagttcatttcatagacggcacttcgattcagaatgtagatcacatcatatgggcgacaggattccaatacggtgtcccgttccttaaatcgtatcattcagatttgtttcgaaatcaatcgaaccgtttgtacaacttatgggaacaaatagtatacaaaccggacccaacaatattcttctcactcctaccaaaaaacatcatcccattccaattggctgagttgcaagcctctatcatcgatcttgtcatcctgggatcaatcactaagtcagatatggttgacgctgacaacgagagtatcacttcctctgattatcactctttaccaacaccaaaggatatagaatattatcagcatttaggatcaattgtagccagacatggaccagattccaagttcaagccactaacatggaccgattccttagttcaagaacgaatttcgtcatcgaaagtgaaagcagaacgacagaaactactagttcaatgggcaatacaccaaaatttacaaaacaagccttacagtatcccaccagatgatttcaccggttga

SEQ ID NO: 11524 - protein, 423 aa, Kluyveromyces lactis NRRL Y-1140
MVSIGIIGAGPAGIAAARVLIANDRSYDIDLFETSSKIGGVWNYDPQSNNTAMYDVLETNLSSHLMAFKDYPFTNIDPNIKTFPGREQVQQYLESYYDSTVANYSKLGLFTEKRVISLEKVDSHWELKADSDDSTYIYDYIVVANGHFNKPFIPTVPGSYQWKNQSHSKNFVNSEHYRGLNVVVVGNASSATDIATQISTTASKVYHSVKPDSETNWPANSIIEVVSQIQSLDEPNSNTVHFIDGTSIQNVDHIIWATGFQYGVPFLKSYHSDLFRNQSNRLYNLWEQIVYKPDPTIFFSLLPKNIIPFQLAELQASIIDLVILGSITKSDMVDADNESITSSDYHSLPTPKDIEYYQHLGSIVARHGPDSKFKPLTWTDSLVQERISSSKVKAERQKLLVQWAIHQNLQNKPYSIPPDDFTG

SEQ ID NO: 11525 - DNA, 1362 bp, Debaryomyces hansenii CBS767
  CDS (1)..(1362)
atgatgctggttagatatacaaggatagcaattattgggggtggccctgctggacttgcggctgctaaatcgtttggattactgcctactaattttgaagttgatttgttcgaacgaaatgacaacttaggaggagtgtggttgtatactggaaaaaagccaaacggattgaaagaaatcaaagatattaataatccatcagttggtagaaatgaattattctcgccaatgtataagtatttggagacaaatattacaggaaagctaatgcaatatgccaacagtacttttccacctgatgcttttgtatatcctactagacaagaagttttccaatatttacaagaatactctaatacgatcccacaaagtacaaaaattcatttgaattctaatgttctctcattgactaaaaaaaactcgatatgggaagtacaggtagaaaatttgaaggataaaaagacatcgataaaacaatacgatgccattgttcttgccaatgggcatttcgaagtaccttttattccaagagtcaacggcctaaactcttggcacataaagctgcctctgtcgataacccatgcaaagtattttactgacccgaatgactttgccaacaagaatgttcttgttgttggaagttcatctagtggtacggacattgcaatacaattgactgtcaggtgcaataaggtatatgtttccaataggtctaattctcttgggcccgaatttaaaaaccttcgtgctaaggttattggacttataacgaaatatgattttgacaacaatagatctgtaaccactgcggaaggtgaaactgtaagtgatattgatgccgtgattttttgtaccggttacagatatgactttccgttcttaaagagttatatggatgacggttctattatagacgctgaaggaactatggttcataatatttacaagcaaatgttttatatcccagatccgtccttggcctttttcgcgttaccaaaacagattgttcctatgccactagctgaatcgcaggctgctgttttgtccagagtcttcagcggcaagatggagctaccagataaagaaactatgatctctgaatattcaaaggagctcgaaatgaaaggtaaggaattccacaacctaaaattccctgctgatgcagactattgtaaatcattacaagaatggattgacctgaacaatcttaccaattatggtctacatgcgcctacttgggataaggaaaaatatgaagataggagtatatcaggttcaatgaaatcagatagaatatccgaggtcattgaacatgccaatactttaagagataaaggcgaaggtttcagattgttacgatga

SEQ ID NO: 11526 - protein, 453 aa, Debaryomyces hansenii CBS767
MMLVRYTRIAIIGGGPAGLAAAKSFGLLPTNFEVDLFERNDNLGGVWLYTGKKPNGLKEIKDINNPSVGRNELFSPMYKYLETNITGKLMQYANSTFPPDAFVYPTRQEVFQYLQEYSNTIPQSTKIHLNSNVLSLTKKNSIWEVQVENLKDKKTSIKQYDAIVLANGHFEVPFIPRVNGLNSWHIKLPLSITHAKYFTDPNDFANKNVLVVGSSSSGTDIAIQLTVRCNKVYVSNRSNSLGPEFKNLRAKVIGLITKYDFDNNRSVTTAEGETVSDIDAVIFCTGYRYDFPFLKSYMDDGSIIDAEGTMVHNIYKQMFYIPDPSLAFFALPKQIVPMPLAESQAAVLSRVFSGKMELPDKETMISEYSKELEMKGKEFHNLKFPADADYCKSLQEWIDLNNLTNYGLHAPTWDKEKYEDRSISGSMKSDRISEVIEHANTLRDKGEGFRLLR

SEQ ID NO: 11527 - DNA, 1350 bp, Yarrowia lipolytica CLIB122
  CDS (1)..(1350)
atgaaacatctcaagtctgtggctatcattggaggaggtcccagcgcggctccgtgcatcaaggcgcttttggccgagaattactttggcaaaatcaccgcctacgaacagcaaccggcacctggagcaggagtatggaattacaacggcctgacccggccgacaccgaacctgccatgcactcgtgacatgcccgcagagcccattgagcacaaaaaggacggctccatcatctactacaaccccatgtacagagatctcaacactaacttgccccacatgttgatggcgtacaaggatttccccttccccgagggcgtggatttgtttcccaaacgacaggttgtcaaacagtacgtgcaggactacgcccggcatgtcgtggaccatttcaagtttgaaaccatggtcaccggcttgaaaaagacgggagacgtgtggatggtggagtccaagtacgtcggaccccatgccaaggaaaacgtccagcccgagctcgaaacatatgattacgtcatcgtatgcaccggccactattcccatccgtttgtgcctgacgttccgggtctgaaggcgtactcagacaagcatgaggttctgcatgccaagtactttgacaacccggattcgtatgttggaaagaccgttttggtggttggaaactcgtcttccggcattgatatcgccaaccaggcggcaaaaaccgccaaaaaggtcattgtctctgccagatcgccttccaatgcccccaccaagggaaacattgagactgttggtgtgattactaagttccacggtgatgatattgatgtcgagggagctccaggagtggagggttcgtctccccaaactctctctgacgttgatgtggtcatctattgcactggatacttgtattcgttcccttttctgcactcctacgtgcaccattcagacgatgacctcatcaccgatggagttcggattcgaaacctctacagacagctgttttacatcaacgacccatccattgcgttcatcggaatgcccaaaaacgtggtgcccttccctctggctgaaacccaagcagctgttgtggctcgagtgtggtctggaagattgaaattgccttctaaggagacccaatttgagtctctgcggaaagaagagaaggaaagaggcactggatctgcccatcatacactgaaacaccccctggatgccgagtaccagcaggctctcactgactggctcaaggccgatacctaccccgatccagacaagggcttctttggagtggagtgggatgaagagcggtataattggagacgaaatgtcaagaagccgcagttgggagatttgagtctgtga

SEQ ID NO: 11528 - protein, 449 aa, Yarrowia lipolytica CLIB122
MKHLKSVAIIGGGPSAAPCIKALLAENYFGKITAYEQQPAPGAGVWNYNGLTRPTPNLPCTRDMPAEPIEHKKDGSIIYYNPMYRDLNTNLPHMLMAYKDFPFPEGVDLFPKRQVVKQYVQDYARHVVDHFKFETMVTGLKKTGDVWMVESKYVGPHAKENVQPELETYDYVIVCTGHYSHPFVPDVPGLKAYSDKHEVLHAKYFDNPDSYVGKTVLVVGNSSSGIDIANQAAKTAKKVIVSARSPSNAPTKGNIETVGVITKFHGDDIDVEGAPGVEGSSPQTLSDVDVVIYCTGYLYSFPFLHSYVHHSDDDLITDGVRIRNLYRQLFYINDPSIAFIGMPKNVVPFPLAETQAAVVARVWSGRLKLPSKETQFESLRKEEKERGTGSAHHTLKHPLDAEYQQALTDWLKADTYPDPDKGFFGVEWDEERYNWRRNVKKPQLGDLSL

SEQ ID NO: 11529 - DNA, 1467 bp, Aspergillus nidulans FGSC A4
  CDS (1)..(1467)
atggcgttgtccaagcacatacaccggatagcggtcatcggcgctgggccagccggccttacttctgtgaaatacctactggcagaaaaatgctttgatacggtagatgtctttgagcgaagaagtcacatggggggcgtgtggaactatagtcctggaacgctgaaggaggctgtttccacgccagtacctcaactcagtccggacgaagacatacaggaaccagtctggcttcctcgggatgcatccaggccgaaccaagagcctacttttatctccccaatatatgatactctggacacgaatctgccgaaggagttgatggcgttcggcgagaagcaatttccatccgatgtgcaggatttcccaaggcatttcacggtcaaagaatacgtgagggagtatggggaggatatcaagaaacatattcagtttgaaacccaggttctggatgttcaaaaggatagcagcacagagacttggtcagtgacaacacaaagcctccgcagcgggactacgacaactagttcctacgatgctgttgtggctgcaagtggccatttcgacgtcccatatctaccagaaatccggggcatcgtgagctggaataacgcctaccctggtgttattacacactccaagttctatgacgtgccagatcccttcaggaacaagaaggttgtggttgttggaagttccgcatccgggcttgatatcggcaaccagatcagtaaagtctgtaaaggaaaggtcctcgcatcacagcggacggatctttatgtgtcaccttccacagccatggacaaagcctattaccccgaaattgtggagttccttcctcctgctacacacgagagggctgttcgatttgcggacggaagggttgaagacaatattgacgctatcatcttctgcactggttttctttattctttcccttatctctcctctctcactcctcccatcattacacatggccgcagagtagagaacacctaccagcatcttttctacatccatgaccctacccttgttttcccagtcctgccccaaagaatcattcctttcccactctctgagaaccaggctgcagtattctcccgcgtctggtccggtcgcctcaagcttccgtctacagcagaaatgaaatcatgggaaaattcggctgtcgcccagaaaggcgatggtcctggatttcaccttatgccttacccactagacgccaattacctaaacatgctccatgattgggtatctacagccgaatcacgccccgggcttgtcaatgacggcaatggcaagccgtgcaatcgttgggggaggaaagaaaggtggatgcgagagatggttcctgagatgcgcaaagcatttttcagcaagggcgaagaacggcgtttggtcaagaccctggaagaacttgggtatgacttcaaccgatggcggactgagcaagaccacttcccatag

SEQ ID NO: 11530 - protein, 488 aa, Aspergillus nidulans FGSC A4
MALSKHIHRIAVIGAGPAGLTSVKYLLAEKCFDTVDVFERRSHMGGVWNYSPGTLKEAVSTPVPQLSPDEDIQEPVWLPRDASRPNQEPTFISPIYDTLDTNLPKELMAFGEKQFPSDVQDFPRHFTVKEYVREYGEDIKKHIQFETQVLDVQKDSSTETWSVTTQSLRSGTTTTSSYDAVVAASGHFDVPYLPEIRGIVSWNNAYPGVITHSKFYDVPDPFRNKKVVVVGSSASGLDIGNQISKVCKGKVLASQRTDLYVSPSTAMDKAYYPEIVEFLPPATHERAVRFADGRVEDNIDAIIFCTGFLYSFPYLSSLTPPIITHGRRVENTYQHLFYIHDPTLVFPVLPQRIIPFPLSENQAAVFSRVWSGRLKLPSTAEMKSWENSAVAQKGDGPGFHLMPYPLDANYLNMLHDWVSTAESRPGLVNDGNGKPCNRWGRKERWMREMVPEMRKAFFSKGEERRLVKTLEELGYDFNRWRTEQDHFP

SEQ ID NO: 11531 - DNA, 1392 bp, Candida albicans SC5314
  CDS (1)..(1392): transl_table=12
atgacaaaagaacaaattgatgaaccacgctataaacgtatagcagtgatagggggtggacctactggactagctgctgttaaagcattaagtttagaacctgttaacttttcatgtattgaccttttcgaaagaagagatcgattaggtggattgtggtatcaccacggagacaagtcattagttaagcctgaaattcccagcctttctccttcacaagaagagattgtttccgacaatgcaacacccgctgacgaatacttttcagcaatctatgaatacatggaaaccaatattgtgcaccaaattatggagtattctggtgtggcattccctgccaattctaagaaataccccactagatcacaagttttagaatacattgacgactatatcaaactgattcccaaagatacagtcaatattagtataaactctaatgtggtgtcattggaaaaggtcaatgagatttggcatatagaaattgaagatgtaatcaagaaaactcgtgccaagttgagatatgatgcagtaattattgccaatggacattttagtaacccatatatccctgatgtgcctggattatcatcttggaataaaaattacccaggtacaatcactcactccaaatattacgagtcaccagccaaatttagagacaaacgtgttttggtggttggaaattcggcaagtggagtagatatttctattcaattaagtgtttgtgccaaagatgtatttgtttccataagagatcaagaatccccacattttgaagatgggttttgcaagcatattggactcattgaagaatacaattatgaaactcgttcagtgcgaacaacagatagagaagtggttagtgatattgattacgtgatattttgcacgggatatttgtatgctctcccatttttgaaacaagaacgaaatattacagatggatttcaagtgtacgacttgtataagcaaattttcaatatttacgatccatccctcacatttttagctctattacgtgatgttattccaatgccaatatccgagtctcaagctgcattaattgcaagagtttatagtggaagatacaaattgccaccgaccgaagaaatggagagatattatcaactagaattgaaagaaaagggtcgaggagggaaattccataattataagtatccacgggatgttgcatattgtcaaatgttacagactcttattgatgaacaaggtttgcatacccctgggctagtggcacctatttgggatgaatctttgattaaaaagagaagtgaaactagagctgagaaaaacgcacgattaaagaatgtggttgagcatgttaaacgtttaagagcagaaggaaaagacttttctttgttagagtag

SEQ ID NO: 11532 - protein, 463 aa, Candida albicans SC5314
MTKEQIDEPRYKRIAVIGGGPTGLAAVKALSLEPVNFSCIDLFERRDRLGGLWYHHGDKSLVKPEIPSLSPSQEEIVSDNATPADEYFSAIYEYMETNIVHQIMEYSGVAFPANSKKYPTRSQVLEYIDDYIKSIPKDTVNISINSNVVSLEKVNEIWHIEIEDVIKKTRAKLRYDAVIIANGHFSNPYIPDVPGLSSWNKNYPGTITHSKYYESPAKFRDKRVLVVGNSASGVDISIQLSVCAKDVFVSIRDQESPHFEDGFCKHIGLIEEYNYETRSVRTTDREVVSDIDYVIFCTGYLYALPFLKQERNITDGFQVYDLYKQIFNIYDPSLTFLALLRDVIPMPISESQAALIARVYSGRYKLPPTEEMERYYQLELKEKGRGGKFHNYKYPRDVAYCQMLQTLIDEQGLHTPGLVAPIWDESLIKKRSETRAEKNARLKNVVEHVKRLRAEGKDFSLLE

SEQ ID NO: 11533 - DNA, 1353 bp, Silicibacter pomeroyi DSS-3
  CDS (1)..(1353): transl_table=11
atgaccaccagcaaacgtgtggcgatcatcggcgcgggaccgtccggcctggcgcaattgcgcgcctttcaatccgccgccgccaagggcgaggagatccccgagatcgtctgtttcgagaaacaggacaactggggcgggctgtggaattacacctggcgcaccgggctggatgaaaacggcgagcccgttcattgctcgatgtatcgctacctgtggtcgaacggccccaaggaaggtctggaattcgccgactattcgttcgaagagcatttcggcaagcagatcgcgtcctaccctccgcgcgccgtgctgttcgattatatcgagggccgggtgctgaaggccaatgtgcgcgactggatccggttcagcaccgccgtacgctggatcgactacaatgacgagaccggcctgttcaaggtcaccgtgcatgaccacaccaatgaccgcgtctattccgaggaattcgatcatgtgatctgtgcctcgggccatttctcgaccccgaacgtgccccattacgagggattcgaaaccttcaacggccggctggtgcatgcccatgacttccgcgacgcgcgcgaattcgcgggcaaggacattctggtcgtcggctcctcctactcggccgaggatatcggctcgcagtgctggaaatacggcgccaagtcgatcacctcatgctatcgctcggcgcccatgggcttcaaatggcccgacaactgggaagaaaagcccgcgctggtcaaggtcgacaagaacaccgtgttcttctcggacggcacctcgcgcgaggtggacgcgatcatcctgtgcaccggctacaagcatttcttcaacttcctgcccgacgatctgcgcctgaagaccgccaaccgcctggccaccgccgatctctacaagggtgtggtctatgtccataaccccaagatgttctatctaggcatgcaggaccagtggttcaccttcaacatgttcgacgcccaggcctggtgggtgcgcgacgcgatcatgggcaagatcgacctgtccaatgtcaccaaggaacagatgctggcagacgtgactgagcgggaaacccgcgaagaggccagcgatgacgtgaaatacgcgatccgctatcaggccgattacgtcaaggaactggtggccgaaaccgactatcccagctttgacatcgacggcgcctgcgaggccttcttccaatggaagaaacacaagggcgaagacatcatggccttccgcaacaacagctatacctcggtcatcaccggcacgctggccccggtgcatcacaccccgtggaaggacgcgctggacgacagcatggaggcgtatctgcgcaactga

SEQ ID NO: 11534 - protein, 450 aa, Silicibacter pomeroyi DSS-3
MTTSKRVAIIGAGPSGLAQLRAFQSAAAKGEEIPEIVCFEKQDNWGGLWNYTWRTGLDENGEPVHCSMYRYLWSNGPKEGLEFADYSFEEHFGKQIASYPPRAVLFDYIEGRVLKANVRDWIRFSTAVRWIDYNDETGLFKVTVHDHTNDRVYSEEFDHVICASGHFSTPNVPHYEGFETFNGRLVHAHDFRDAREFAGKDILVVGSSYSAEDIGSQCWKYGAKSITSCYRSAPMGFKWPDNWEEKPALVKVDKNTVFFSDGTSREVDAIILCTGYKHFFNFLPDDLRLKTANRLATADLYKGVVYVHNPKMFYLGMQDQWFTFNMFDAQAWWVRDAIMGKIDLSNVTKEQMLADVTERETREEASDDVKYAIRYQADYVKELVAETDYPSFDIDGACEAFFQWKKHKGEDIMAFRNNSYTSVITGTLAPVHHTPWKDALDDSMEAYLRN

SEQ ID NO: 11535 - DNA, 1296 bp, marine gamma proteobacterium HTCC2143
  CDS (1)..(1296): transl_table=11
gtgaggatagctgtaatcggtgcgggtgctgcgggtttggtaactgcacgagagctcagtcgtggcggtcatgatgtctctgtttttgaacagtctgaccgcgtgggtggtgtttggatttttgaacccatcccagaagacgatgcaatgggtctgaagcccagcaaagcggtattctcgtcaatctacgattcgctgcggacaaatttaccgcgtgatctcatggcattccaggattataccttcgactccatgggcggcggagaagacgaatggcagcgatatcctcaccattcgaaggttctgacatacttagaaaactttgctgagagcttcgatattacatctatgattcgttttcagcgtacagtctctcgagtcgaaaaattggacgctgactgggttgtcaccagtgaacacgtacaatctggagaaatcgagcggcagcgttttgatggtgtggctgtgtgcagtggccattattctaaacctcgagttccagtcattgccggagttgatacattttctggtaggctcatgcacagtcataattatcgaagtccggcggagtttgctaacaagcgagtggtattgttagggacagctgcatctggcgtagatatcgcaagggaaatagcgactgtgtctgatcaggtctactggtgcggcaatacattctcgcaagtctcatatgatgagcaaagtggtttgcatcggtatccaacccctttagcgtttgatggagcggcgattcgctttcaaaatgcccccgctctggaaaatgtggattattttatttactgcacgggttaccaataccaataccctttcttgcaaaccaatcttgttaacgttgtcgacaactgggtgagccctctataccgcgatattgttgcaccaaccgacaccacgctagcttttattggtttaccgtttcaggttattcccttccctctgtttgaatatcaggctaaatggtgggttaatatgctgtcggggaccaagtcactaccgtcagtaaaagccatgatgatggaaataagcggtaagattgctgcgcagaatgaagccggtattaaaacccatcatcgacataaattggcagaaaaacagttcgactattttgatagcttggcggctgattgcggagaaccaccggtggctgattggataaaagcattagcgatagagacgttgcgatcacatgttgaaaatccggggaaatttcgagaaacagcgctagtgggtcagggacctacggtagtcagagtgatagaaaagcaaaaggaagaataa

SEQ ID NO: 11536 - protein, 431 aa, marine gamma proteobacterium HTCC2143
MRIAVIGAGAAGLVTARELSRGGHDVSVFEQSDRVGGVWIFEPIPEDDAMGLKPSKAVFSSIYDSLRTNLPRDLMAFQDYTFDSMGGGEDEWQRYPHHSKVLTYLENFAESFDITSMIRFQRTVSRVEKLDADWVVTSEHVQSGEIERQRFDGVAVCSGHYSKPRVPVIAGVDTFSGRLMHSHNYRSPAEFANKRVVLLGTAASGVDIAREIATVSDQVYWCGNTFSQVSYDEQSGLHRYPTPLAFDGAAIRFQNAPALENVDYFIYCTGYQYQYPFLQTNLVNVVDNWVSPLYRDIVAPTDTTLAFIGLPFQVIPFPLFEYQAKWWVNMLSGTKSLPSVKAMMMEISGKIAAQNEAGIKTHHRHKLAEKQFDYFDSLAADCGEPPVADWIKALAIETLRSHVENPGKFRETALVGQGPTVVRVIEKQKEE

SEQ ID NO: 11537 - DNA, 1389 bp, Vitis vinifera
  CDS (1)..(1389)
  misc_feature (345)..(345): y is t or c
  misc_feature (411)..(411): r is g or a
  misc_feature (417)..(417): w is a or t
  misc_feature (479)..(479): y is t or c
  misc_feature (1182)..(1182): y is t or c
  misc_feature (1202)..(1202): y is t or c
  misc_feature (1349)..(1349): r is g or a
atgctttcagagaggaagcaatccaaatacgtatgcgtgatcggggctggtccgtcggggctggtgaccacgagggagctaaggaaggagggccactgtgtggtgatgatggagcagaaccatgatgttggagggcagtggctatatgaccctaacgttgagggcgaggaccctttggggaggagtaaatttttgaaggtccatagtagcatctatgcttctctgaggctggctagtcctagagagatcgtggggttcagtgattttccatttgtggtgaagaaaggtagggacacgaggaggtttcctgggcacagggaacttctatggtaccttgaggacttytgtgaatggtttgggctgagggagacgataaggttcaatactaaggtggagtatgtggggatgttrgattcwgatgaagtaggtggaggtttgaagtgggttgtgaggagcagagacgtcaagtctgaaaaggyggtggaggagctgtttgatgctgtggttgtggccacaggccagtactctcaccctaggttgccttccattaaaggaatggaagcatggaagaggaagcaaatgcatagtcacatctacagggtccctcacccatttcacaatgaggtagtggtggttgtaggaaatgcagcgagtggacaggacatatccatagagcttgtggatgtggcaaaagaaatccatctaagtgccaaatctctagatatttctgagggtctatctagaattatttccaaacaccacaacttgcatcttcatctgcagattgaatcccttcatgaagatggacgagtagtatttgtagatgggtcttgggtcgtggcagacactatcatatactgcaccgggtattcatattccttcccatttcttgacaccaaaggaatagtagcagtggatgatgacagagtaggcccattgtatgagcataccttccctccctccctcgcaccctctctatcttttgtgggcattcccaggaagatcctaggtttccctttctttgaatcacaagcaatgtggatagctcagctgctgtctgggagaaaaacattaccatcattccatgatatgatgcggtccattgaagacttctatcagtcaagagatgccgctggcattccaaagcatcaaactcacgatattgcagattttgagtacttygataaatatggagacaatgytgggttcccacacacggaagaatggaggaagaagctactcttatcaaccgtaggaaatgcccaagtcaacttggagacttaccgtgattcttggtatgatcatgagctgttgcaagtgttatccaatttgatccaaatcattttccrtagttcaaaggtgagatgtaagaggaggaaggttgactga

SEQ ID NO: 11538 - protein, 462 aa, Vitis vinifera
  misc_feature (160)..(160): The Xaa at location 160 stands for Ala, or Val.
  misc_feature (401)..(401): The Xaa at location 401 stands for Ala, or Val.
  misc_feature (450)..(450): The Xaa at location 450 stands for Arg, or His.
MLSERKQSKYVCVIGAGPSGLVTTRELRKEGHCVVMMEQNHDVGGQWLYDPNVEGEDPLGRSKFLKVHSSIYASLRLASPREIVGFSDFPFVVKKGRDTRRFPGHRELLWYLEDFCEWFGLRETIRFNTKVEYVGMLDSDEVGGGLKWVVRSRDVKSEKXVEELFDAVVVATGQYSHPRLPSIKGMEAWKRKQMHSHIYRVPHPFHNEVVVVVGNAASGQDISIELVDVAKEIHLSAKSLDISEGLSRIISKHHNLHLHLQIESLHEDGRVVFVDGSWVVADTIIYCTGYSYSFPFLDTKGIVAVDDDRVGPLYEHTFPPSLAPSLSFVGIPRKILGFPFFESQAMWIAQLLSGRKTLPSFHDMMRSIEDFYQSRDAAGIPKHQTHDIADFEYFDKYGDNXGFPHTEEWRKKLLLSTVGNAQVNLETYRDSWYDHELLQVLSNLIQIIFXSSKVRCKRRKVD

SEQ ID NO: 11539 - DNA, 1365 bp, Vitis vinifera
  CDS (1)..(1365)
atggtttcagagaggaaccaatctaagcacgtatgcgtgatcggggcggggccatcggggctggtggcggccagggagctaagaaaagagggccacagtgtggtggtgatagagcaaaaccatgatattggagggcagtggctgtatgaacccaaagtggagggtgaggaggctttagggaagagtacatttttaaaggtccatagcagcatctatgactctctgaggctgttttctcctagagaaatcatggggttcagtgattttccatttgttgtaaagaaaggtagggacatgaggagatttccagggcacagggagcttctcttgtacctgcaagacttttgtgaatggtttgggctcagggagatgataaggttcaaaactagagtagagtatgtggggatgttggattctgatcaagttggcagagatttgaagtgggttgtgaaaagcagggacatggagtctgaaaaggtggtggaggaggtgtttgacgcagtggttgtggcaacgggccactactccaagcctaggttgccttccattaaaggaatggatgtctggaaaaggaaccaaatgcatagccacatctacagggatcctgagccattccgcaaagaggtggtggtggttgttggaaattcattgagtggacaagacatctctatggaacttgtggatgtggccaaagaaatccatttaagtgccaaatctcttgaaatttcggagggtctagctaaagtcatttccaaacacgacagcttgcacctgcatctagagattgaatcccttcatgaagatggacgagtggtatttgtagatgggtcttgggtcatggcagacaccatcatatactgcaccgggtattcatatgccttcccatttcttgacaccaaaggaatagtaggagtggatgatgacagagtaggcccattgtatgagcacaccttccctccatccctcgcaccctctctatcttttgtgggcattcccagaaagctcatagggttccctttctttgaatcacaagcaatatggatagctcagctactgtctgggaaaagaacattaccatcattccatgacatgatgcaatccattaaagacttctatcactccagagagattgctggcgtcccaaaacacaatactcacgatcttgccaattttgagtactgtgataaatatggagataatgttgggttcccgcacttggaagaatggaggaaagagctatgcatatcggccatagtaaaggccgaggtggacttggagggttacagggatgcttgggacgacgtcgagctgctgcaagtggctcttcaaagccctcatttcactcaattccctcgatctacttga

SEQ ID NO: 11540 - protein, 454 aa, Vitis vinifera
MVSERNQSKHVCVIGAGPSGLVAARELRKEGHSVVVIEQNHDIGGQWLYEPKVEGEEALGKSTFLKVHSSIYDSLRLFSPREIMGFSDFPFVVKKGRDMRRFPGHRELLLYLQDFCEWFGLREMIRFKTRVEYVGMLDSDQVGRDLKWVVKSRDMESEKVVEEVFDAVVVATGHYSKPRLPSIKGMDVWKRNQMHSHIYRDPEPFRKEVVVVVGNSLSGQDISMELVDVAKEIHLSAKSLEISEGLAKVISKHDSLHLHLEIESLHEDGRVVFVDGSWVMADTIIYCTGYSYAFPFLDTKGIVGVDDDRVGPLYEHTFPPSLAPSLSFVGIPRKLIGFPFFESQAIWIAQLLSGKRTLPSFHDMMQSIKDFYHSREIAGVPKHNTHDLANFEYCDKYGDNVGFPHLEEWRKELCISAIVKAEVDLEGYRDAWDDVELLQVALQSPHFTQFPRST

SEQ ID NO: 11541 - DNA, 1383 bp, Vitis vinifera
  CDS (1)..(1383)
atggtttcggagagaattcaatccaagcatgtatgcgtgatcggcgctggaccgtcagggctggtggccgcgagggagctaagaaaagagggtcacagtgtggtggtgatggagcaaaaccatgatattggagggcagtggctgtatgaacccaaagtggagggtgaggatgctttagggaagagtacatttttgaaggtccatagcagcgtctatgactctctgaggctgttctctcctagagaaataatggggttcagtgattttccatttgttgtaaagaaaggtagggacatgaggagatttccagggcacagggagcttctcttgtacctgcaggacttttgtgaatggtttgggctcagggagatgatgaggttcaagacaagggtagagtatgtggggatgctggattctgatcaagttggcagagatttgaagtgggttgtggaaagcagagacatggagtctgaaaaggtgtcggaggaggtgttcgacgcggtggtggtggcaaccggccactattctaagcctagattgccttccattaaaggaatggatgtatggaaacgaaagcaaatgcacagtcacatgtacagggttcctgagccatttcgccatgaggtggtggtgatagttggaaactcacatagtggagaggacgtatccatagggcttgtggaagtggcaaaagaaatacatctgagtttcaaatctcttgatctttctgaaggtctctctaaattcatctccaagcatcacaacttgcaccttcatttgcagattgaatcccttcatgaagatggacgagtagtatttgtagatggctcttgggtcatggcagacaccatcatatactgcactggatattcatattccttcccatttctggacaccaaaggaatagtagtagtggatgataacagagtaggaccattgtatgagcacaccttccctccattgctagctccttctctatcttttgtcggcattcctcgcaagatcatagcgttccctttctttgaatcgcaagcaatatggatagctcagctgctgtctgggaaaaaaacactaccctcattccatgacatgatgcactccattgaagacttctatcgatcaagagagattgctggcatcccaaagcgttacactcatgagcttgccgattttgagtactgtgataaatatggagacaatgttgggttcccacacttggaagaatggaggaaagggctatgcgtatcggccgtgctaaaggccatggccaacttggagacttttcgtgattctggggatgaagatgagctgctgcaagtggctcttcaaagccctcatttcactcaatttcctcagtctccgtctcaacattttactacatga

SEQ ID NO: 11542 - protein, 460 aa, Vitis vinifera
MVSERIQSKHVCVIGAGPSGLVAARELRKEGHSVVVMEQNHDIGGQWLYEPKVEGEDALGKSTFLKVHSSVYDSLRLFSPREIMGFSDFPFVVKKGRDMRRFPGHRELLLYLQDFCEWFGLREMMRFKTRVEYVGMLDSDQVGRDLKWVVESRDMESEKVSEEVFDAVVVATGHYSKPRLPSIKGMDVWKRKQMHSHMYRVPEPFRHEVVVIVGNSHSGEDVSIGLVEVAKEIHLSFKSLDLSEGLSKFISKHHNLHLHLQIESLHEDGRVVFVDGSWVMADTIIYCTGYSYSFPFLDTKGIVVVDDNRVGPLYEHTFPPLLAPSLSFVGIPRKIIAFPFFESQAIWIAQLLSGKKTLPSFHDMMHSIEDFYRSREIAGIPKRYTHELADFEYCDKYGDNVGFPHLEEWRKGLCVSAVLKAMANLETFRDSGDEDELLQVALQSPHFTQFPQSPSQHFTT

SEQ ID NO: 11543 - DNA, 1371 bp, Methylophaga sp
  CDS (1)..(1371): transl_table=11
atggcaactcgtattgcgatacttggtgcaggcccaagtggtatggcacaactcagagcattccaatccgcccaggaaaaaggtgctgagatccctgaactcgtttgttttgaaaaacaagctgattggggcggccagtggaattacacatggcgcactggtttagatgaaaatggcgaacctgttcatagcagtatgtatcgctatctgtggtcaaacggcccgaaagaatgtcttgaatttgctgattacacgtttgacgaacactttggtaagcccatcgcctcttatccaccccgtgaagtcttatgggactatattaaaggccgtgttgaaaaagccggcgtcagaaaatatatccgttttaataccgctgttcgtcatgttgaattcaacgaagacagccaaacttttaccgttaccgtgcaggaccatactactgacacaatttactctgaagagtttgactatgttgtctgttgtaccggtcacttctcaacaccttacgtgcctgaatttgaaggctttgaaaaatttggtggccgcattctgcatgcccatgacttccgtgacgcattagaatttaaagacaaaactgtattactggtcggcagcagttactcagctgaagatatcggctcacaatgttataaatacggcgcgaaaaaactgatcagctgctaccgtaccgcaccgatgggttataaatggcctgaaaactgggatgaaagacccaacctggttcgtgttgatactgaaaacgcttattttgccgatggttcatcagaaaaagtcgatgcgattattctgtgtaccggttatatccatcacttccccttcctcaatgacgatctgcgtctggtcaccaataaccgtttatggccgctcaacctttataaaggcgtggtgtgggaagataatccaaaattcttctacattggcatgcaggatcaatggtacagcttcaatatgtttgatgcccaagcctggtatgcccgtgatgtgattatgggtcgactgccattgccatcaaaagaagagatgaaagccgacagcatggcctggcgtgaaaaagaactgacgctggttacggctgaagaaatgtacacctaccagggtgactacattcagaatctgattgatatgactgactatccgtcatttgatattccggcaaccaacaaaactttcctggaatggaaacatcacaaaaaagaaaacatcatgactttccgtgaccactcataccgttcactgatgactggcacgatggcaccgaaacatcacacaccatggatagatgcactggatgattctctggaagcctatctctctgataagagcgaaattcctgtggctaaagaagcttaa

SEQ ID NO: 11544 - protein, 456 aa, Methylophaga sp
MATRIAILGAGPSGMAQLRAFQSAQEKGAEIPELVCFEKQADWGGQWNYTWRTGLDENGEPVHSSMYRYLWSNGPKECLEFADYTFDEHFGKPIASYPPREVLWDYIKGRVEKAGVRKYIRFNTAVRHVEFNEDSQTFTVTVQDHTTDTIYSEEFDYVVCCTGHFSTPYVPEFEGFEKFGGRILHAHDFRDALEFKDKTVLLVGSSYSAEDIGSQCYKYGAKKLISCYRTAPMGYKWPENWDERPNLVRVDTENAYFADGSSEKVDAIILCTGYIHHFPFLNDDLRLVTNNRLWPLNLYKGVVWEDNPKFFYIGMQDQWYSFNMFDAQAWYARDVIMGRLPLPSKEEMKADSMAWREKELTLVTAEEMYTYQGDYIQNLIDMTDYPSFDIPATNKTFLEWKHHKKENIMTFRDHSYRSLMTGTMAPKHHTPWIDALDDSLEAYLSDKSEIPVAKEA

SEQ ID NO: 11545 - DNA, 1344 bp, Schizosaccharomyces pombe
  CDS (1)..(1344)
atgtgtcttccaacaattcgaaaaattgcaatcattggtgctggtccctctggattagttacggctaaagcgctgttagcagaaaaggcgtttgaccaggtcacgctttttgagcgaagggggtctccgggtggtgtttggaactatacaagtactttatcaaataagttaccggttcctagcacaaatcccattttaacaaccgaacccattgtcggaccagctgctttacctgtgtatccttcacctttgtatcgtgatctgcaaactaataccccaattgagttgatgggttattgtgatcaaagctttaaaccccaaactcttcaattcccccatcgacataccattcaggaatatcaacggatatatgcacaacctctgctgccctttataaaattagccaccgatgtcctagatatagaaaagaaggatggctcctgggtcgtgacatacaaaggaacgaaagccggaagcccgattagtaaagatatctttgatgcagtctcaatttgtaatggtcattatgaagtaccctatatccccaatattaaaggtctcgatgaatacgctaaagccgtgccggggtcagttctacactcatcgctattccgtgaaccagaattattcgtgggtgaatcagtacttgtagttggtggtgcttcttctgcaaacgatctcgtccgacacttgacgccagtcgctaagcaccctatatatcaaagtcttcttggtggaggggacatacagaatgaatcgttgcaacaagtacctgaaattactaagttcgatcctaccactagggaaatatacttgaaaggtggaaaagtgttatctaatattgacagagttatttattgtaccggatacttgtattccgtaccatttccttccctggctaagttgaaatcccctgaaaccaagttgattgatgatggtagtcatgtgcacaatgtctatcaacatatattttatatccccgatccaactctggcttttgttggtttagctctacacgttgttcctttccctactagtcaagcacaggcagcgttcctcgcgcgagtttggtctggtcgcctcaaattacccagcaaagaagagcagctgaaatggcaagacgaattaatgttttcgctgagtggagcaaataatatgtatcactctttggattatccaaaagacgctacctacattaacaagctacacgactggtgtaaacaggctacacctgttcttgaagaagagtttccgtcaccgtattggggcgagaaggaacgaagcatccgtgaaaacatgtggtccatccgtgctaagtttttcggaattgaacctccaaagtaa

SEQ ID NO: 11546 - protein, 447 aa, Schizosaccharomyces pombe
MCLPTIRKIAIIGAGPSGLVTAKALLAEKAFDQVTLFERRGSPGGVWNYTSTLSNKLPVPSTNPILTTEPIVGPAALPVYPSPLYRDLQTNTPIELMGYCDQSFKPQTLQFPHRHTIQEYQRIYAQPLLPFIKLATDVLDIEKKDGSWVVTYKGTKAGSPISKDIFDAVSICNGHYEVPYIPNIKGLDEYAKAVPGSVLHSSLFREPELFVGESVLVVGGASSANDLVRHLTPVAKHPIYQSLLGGGDIQNESLQQVPEITKFDPTTREIYLKGGKVLSNIDRVIYCTGYLYSVPFPSLAKLKSPETKLIDDGSHVHNVYQHIFYIPDPTLAFVGLALHVVPFPTSQAQAAFLARVWSGRLKLPSKEEQLKWQDELMFSLSGANNMYHSLDYPKDATYINKLHDWCKQATPVLEEEFPSPYWGEKERSIRENMWSIRAKFFGIEPPK

SEQ ID NO: 11547 - DNA, 1299 bp, Saccharomyces cerevisiae
  CDS (1)..(1299)
atgacagtgaatgacaaaaaaagattggcaatcataggtggggggccaggagggttggcagctgcaagagttttctcgcaaagtcttccaaattttgaaatagaaatatttgtaaaggattacgatattggcggtgtctggcattatccagaacaaaaaagtgatgggagggtcatgtatgaccatttggaaaccaatatatcaaagaagttaatgcagtttagcggctttcccttcgaggaaaacgtccctttatatccgtctcgaagaaacatttgggaatacttgaaagcctattacaaaacgttcattgccaacaaagatgctatcagcatccatttcagcaccgaagttacctacttaaagaagaagaactctcaatgggagataacatctaaagacgaactaaggactactaaatcggattttgacttcgttattgttgcgtctggtcactacagtgtccctaaactaccaactaatatcgcaggtctcgatctatggttcgacaataagggcgcctttcattctaaggatttcaaaaactgcgagtttgcccgtgaaaaagtcgttattgtggtgggaaacggcagttccggccaagatattgccaaccaactaactaccgttgcaaagaaagtatataatagtataaaagagcctgcgagcaatcaactgaaggccaagttaatcgagactgtccaaacaatagacagtgccgattggaaaaatcgttcagttactttatctgatggaagagtacttcagaatatagactacattattttcgccacaggctattattacagctttccatttatagagccctccgttagactggaagtgctaggtgagggtgttactggcgacaagcactcgtctgtcaatctgcacaatttgtgggagcacatgatctatgtaaaagatcctacgctgtcctttatcttgaccccgcagttggtcatcccgttcccgttgtcggaactacaggcggctattatggtcgaagtattctgtaaaagcttaccgataactacaactttcgactctaatgcctgcggaacgcacaacttcccaaagggaaaggacctggaatactatgcagaactacaggaactactgaatagcattccacgtagggtcggtcatttcgaaccagttgtatgggatgatagactgatcgatctaagaaacagtagttatacagacaaagaagaaagaaatgtgcttctagcggaacacgcacaagccctaaagaaaaaaaaagcaccatacttccttccggcgccacatacttaa

SEQ ID NO: 11548 - protein, 432 aa, Saccharomyces cerevisiae
MTVNDKKRLAIIGGGPGGLAAARVFSQSLPNFEIEIFVKDYDIGGVWHYPEQKSDGRVMYDHLETNISKKLMQFSGFPFEENVPLYPSRRNIWEYLKAYYKTFIANKDAISIHFSTEVTYLKKKNSQWEITSKDELRTTKSDFDFVIVASGHYSVPKLPTNIAGLDLWFDNKGAFHSKDFKNCEFAREKVVIVVGNGSSGQDIANQLTTVAKKVYNSIKEPASNQLKAKLIETVQTIDSADWKNRSVTLSDGRVLQNIDYIIFATGYYYSFPFIEPSVRLEVLGEGVTGDKHSSVNLHNLWEHMIYVKDPTLSFILTPQLVIPFPLSELQAAIMVEVFCKSLPITTTFDSNACGTHNFPKGKDLEYYAELQELLNSIPRRVGHFEPVVWDDRLIDLRNSSYTDKEERNVLLAEHAQALKKKKAPYFLPAPHT

SEQ ID NO: 11549 - DNA, 1395 bp, Brassica napus
  CDS (1)..(1395)
atggcacccggtagcaatcatccaaccggctctcgccacgtggcagtgatcggagcaggagccgccggcctcgtggctgctcgtgagctacgtcgtgaaggccactcagtagtcgtgttagagcgcgggagccaaatcggaggcgtgtgggcttacacctctcaagtggaacctgacccgctaagcctagatccggcccgacccgtagtccactccagcctctacaaatccttacgcaccaacatcccccgagagtgcatgggtttcaccgacttccctttttcgacccgaccgcacgacgggtcgagggatccgagaagacatccgggtcacagtgaggttcttgcttacctgcgagactttgctaaagaattcgatatagaggagatgataaggttcgagacggaggttgttagggcggagccggtggcggatgaggagaatagcgggaggtggagggttgagtcaagaagctccgatgctgttgccgatgagatatacgacgccgtcgtggtttgtaacggacactatactgagccacgccatgctcttgtctctggcatagattcatggccaggcaagcaaattcatagccacaattaccgtgttcctgatccattcaaagatcaggtagtaatagtgatcggaagctcagcgagtggcgttgatatatgcagagatatagcaaaagtcgctaaagaagtccacgtctcgtctagatcgacttcactagagacctacgagaagcttcccggttacgacaacctatggcttcacccaacgattgaaactgcccgcgaagatggttcagtggttttcaaaaatggaaagacggtttacgcagataccattatgcactgtacagggtacaagtattactttccgtttcttgacacgaaaggtgaagtgacagtagacgataatcgtgttggaccgttgtataagcatgtatttcctccggctctttcccccggcctttcgttcatcggcctaccatggcagataactccttttccgatgtttgagcttcaaagcaaatgggttgcagcggttttatctggacgggtatctcttccatcgcaagacgagatgatggaagacactaaggctttctacgataagctcgaagcctcgggcattcccaaaagatatactcatttgatgccagatgactcccagtttgagtatgataattggcttgcggatcaatgtgactatccacggatagagaaatggagggaagaaatgttttacatcggtttcaagagaatttatgcacagtccgctacatacagggataattgggacgatgatcacctcatcgtagaagcatacgatgattttgttaagtttatgtcaagttatccagaacttttgccgatgttgaaaacctaa

SEQ ID NO: 11550 - protein, 464 aa, Brassica napus
MAPGSNHPTGSRHVAVIGAGAAGLVAARELRREGHSVVVLERGSQIGGVWAYTSQVEPDPLSLDPARPVVHSSLYKSLRTNIPRECMGFTDFPFSTRPHDGSRDPRRHPGHSEVLAYLRDFAKEFDIEEMIRFETEVVRAEPVADEENSGRWRVESRSSDAVADEIYDAVVVCNGHYTEPRHALVSGIDSWPGKQIHSHNYRVPDPFKDQVVIVIGSSASGVDICRDIAKVAKEVHVSSRSTSLETYEKLPGYDNLWLHPTIETAREDGSVVFKNGKTVYADTIMHCTGYKYYFPFLDTKGEVTVDDNRVGPLYKHVFPPALSPGLSFIGLPWQITPFPMFELQSKWVAAVLSGRVSLPSQDEMMEDTKAFYDKLEASGIPKRYTHLMPDDSQFEYDNWLADQCDYPRIEKWREEMFYIGFKRIYAQSATYRDNWDDDHLIVEAYDDFVKFMSSYPELLPMLKT

SEQ ID NO: 11551 - DNA, 1350 bp, Brassica napus
  CDS (1)..(1350)
atggcaccttccctatcaccaatcagatctcaccacgtggccgtcatcggagccggagccgccggtctagtcgcggcgagggagcttcgacgcgaaggccactccgtcgtcgtcctcgagaggcagaaacaggtcggaggaacatggatctacaccgaccacgtcgagccggatccgctaagcgtagacccgacccgacccgtcgtccactcgagcgtatacgccactctccggaccaacctccctcgcgagtgcatgggatacagagacttcccgttcgtggcccgatccggaggcgatcagaggaggtttccgagccacggagaggttctggcgtatctgcaagagtttgcgaaggagtttaagatcgaggaggtgatacggttcgagacggcggttgagagggttgctccggcgacggagggtgggaacgggaagtggagagttgagtctacggagaaggagaagagagttcgtcgtgacgaggtttatgatgctgttgttgtttgtaatgggcattacattgaacctcgtcttgcagagatccctgggataagttcttggccagggaaggagatgcatagccataactatcgtatccctgaaccttttaaagaccaggtggttgtgcttattgggaactctgcaagtgctgttgatataagtagagacattgctggacatgccaaagaggttcatgtggctggtaggtcaaatccagcggatacgtttatcaaacaacccggttacagtaacctgtggatgcattcaatgattgagcgtgtcaataacgatggttctgtagtttttcaaaacgggcaaacgattttggttgatgttatcatgcattgcactgggtacaagtatcacttcccttttcttgaaaccaatggaagtgttaccgtagatgataaccgtgtcggtccattgtacaaacatgtcttccctccagaattagcaccgtggctctccttcatcgggataccatggcaggttgtaccatttcctttgtttgagctgcaaagcaagtggatagcgggtgttttgtcgggtcggattatgcttccatcaaaggatgatatgatggaggatatcaaatccttgtatgcaacgcttgaagctcaagggattcaaaagcgatatactcaccgtatgggcattgcccaatttgagtacaatgattgggtggctacgcaatgtggatgcccaggaacagaggagtggaggaaagagatgtatttaacgactggtgtgaggaagagagcaaaaccagagacgtacagagacgaatgggaagatcatcacttgatttctcaatctttccaagatttctctttatatacacattaa

SEQ ID NO: 11552 - protein, 449 aa, Brassica napus
MAPSLSPIRSHHVAVIGAGAAGLVAARELRREGHSVVVLERQKQVGGTWIYTDHVEPDPLSVDPTRPVVHSSVYATLRTNLPRECMGYRDFPFVARSGGDQRRFPSHGEVLAYLQEFAKEFKIEEVIRFETAVERVAPATEGGNGKWRVESTEKEKRVRRDEVYDAVVVCNGHYIEPRLAEIPGISSWPGKEMHSHNYRIPEPFKDQVVVLIGNSASAVDISRDIAGHAKEVHVAGRSNPADTFIKQPGYSNLWMHSMIERVNNDGSVVFQNGQTILVDVIMHCTGYKYHFPFLETNGSVTVDDNRVGPLYKHVFPPELAPWLSFIGIPWQVVPFPLFELQSKWIAGVLSGRIMLPSKDDMMEDIKSLYATLEAQGIQKRYTHRMGIAQFEYNDWVATQCGCPGTEEWRKEMYLTTGVRKRAKPETYRDEWEDHHLISQSFQDFSLYTH

SEQ ID NO: 11553 - DNA, 1374 bp, Glycine max
  CDS (1)..(1374)
atggcttccgaaacaaaccagtccaagaatgtgtgtgtaattggagctggaccatcggggctagtggcagcgagggagctgaaaaaagaaggtcacaaggtggttgtgttggagcagaaccatgatattggaggtcaatggctatataacccaaatgtacaagaggaggatcccttaggaagagacccttggctaaaggtgcatagcagcatctatgagtctttaaggttcatgtctcccagagagatcatggggtcaactgatttcccctttttagtcaagaaaggtagagacacaaggaggtttcctagtcatagagagttccttctctaccttaaggacttttgtgaatggtttaagttgagtgagatgatcaagctcaatacaaaggtgcattatgtgggaccattaaattatggtgtccctagtgaggatttgaaatgggttgttagaagcaaagacaacaacagcgaggaggaagttgaacaagtctttgacgcagtggttgtggccactggccattactctaaccccagattgccatgcattcaaggaatggacacatggaaaagaaaacaaatgcacagtcacatttacaggtcgccagagccattccgcggggagatagtggtggtggttggaaattttttaagtggacaagaaatatcaatggaacttgtgaaagtagcgaaggaagttcacctcagttcgaaatctcttatcatttttgagggtttatccaaagtcatatccaaaaacgagaattttcaccttcgtccacagatagacacccttcaagaggatgggactgtgattttcacggatggttccaacattatcgctgacactattttatactgcactgggtacaattattcttacccctttctcgacaccaaaggaatagttgttgtgcatgataccagagtgggtcctttgtatgagcacactttcccaccatcacttgctccttcactttcttttgtaggcatccccggaaagatcctggggatcactttctttgagtcccaaggaaaatggatagcgcaactactgtctgggaaaaaagttttgccatcatatgaggaaatgatggaatccatcgaggagttctatcattcaaatgaagtagctggcattcctaaacgctacacccatgtggttgatgcctttgattattgtgacaaatacggagaaaatgttggattcccaaagacagaagaatggaggaaagagttgtgcatatcagctggaatgaacgcttttgccaacttggagacatatcgtgattcgtggaatgatgatattgatgagaagcttcaggaggcccttcgaagtccttacttcactcaacttgaacaactttctctgtaa

SEQ ID NO: 11554 - protein, 457 aa, Glycine max
MASETNQSKNVCVIGAGPSGLVAARELKKEGHKVVVLEQNHDIGGQWLYNPNVQEEDPLGRDPWLKVHSSIYESLRFMSPREIMGSTDFPFLVKKGRDTRRFPSHREFLLYLKDFCEWFKLSEMIKLNTKVHYVGPLNYGVPSEDLKWVVRSKDNNSEEEVEQVFDAVVVATGHYSNPRLPCIQGMDTWKRKQMHSHIYRSPEPFRGEIVVVVGNFLSGQEISMELVKVAKEVHLSSKSLIIFEGLSKVISKNENFHLRPQIDTLQEDGTVIFTDGSNIIADTILYCTGYNYSYPFLDTKGIVVVHDTRVGPLYEHTFPPSLAPSLSFVGIPGKILGITFFESQGKWIAQLLSGKKVLPSYEEMMESIEEFYHSNEVAGIPKRYTHVVDAFDYCDKYGENVGFPKTEEWRKELCISAGMNAFANLETYRDSWNDDIDEKLQEALRSPYFTQLEQLSL

SEQ ID NO: 11555 - DNA, 1374 bp, Glycine max
  CDS (1)..(1374)
atggcttgcgaagtgccaataaaatccatgatgtccagcgcagtcacactcctgacgccgcgccacgtggcagtgatcggcgcgggcgccgccggcctagtggcggctcgggagctccggcgagaagggcatcgcgtggtggttttcgagaaaggggaggaagtgggtggcatgtgggtgtacagtccggaggtggattcggatccgctgggtttggaggcgaagcggagattagtccactcgagcctctacgattcgctccgaacgaatctgtctcgggagagcatgagtttccgagattaccctttcaggaggagggaggggaaagggagggattctcgaaggttcccgggtcacagagaggagttactgtacttgcaggatttcgctgctgaatttgaaatcggagaattggtgaggtttggaacggaggttttgtttgctggattggatcagtgtggaaagtggaggctgacttcaacatcaccccatactcatcctgtggatgagatttacgacgcccttatcatttgcaacggccattacgttcagcctcgtcttcctcatatccccgggattaatgcatggccagggaagcagatgcatagccataattatagaacacctgagccctttcaagatcaagttgtagttctaattggtagttctgctagtgcggttgatatctctcgagatatcgcaacagttgctaaagaagtccacattgcagctaggtcagttgaagaagataagctaggaaaggtgcctggccatgagaatatgtggcttcattctatgattgacagcgttcatgaagatggtacagtggtttttcaagatggaaatgcagttggtgctgacttcatcatacattgcacagggtacaagtatgattttcccttccttgaaaccaatggggaggtgactgtagatgacaaccgtgtaggaccactctacaaacatgttttcccaccagccttggctccatggctttcttttgttgggttgccttggaaggttgctcccttctccttgttcgaactgcagagcaagtggatagctggaatcttgtctaatcgcattgcacttccttcgaaagaggagatggctaaagacgttgatgctttttactcatcacttgaagcctctggcactcctaagcgttacactcataatatgggcattcttcagtgggactacaataactggattgcggatcagtgtggggttccttctattgaagaatggagaaggcaaatgtatatagccacatctaagaacagggtgctgcgacccgagtcttaccgtgacgagtgggacgatgatgacttggttctgcaagctcaacaggattttgccaattatctcacttga

SEQ ID NO: 11556 - protein, 457 aa, Glycine max
MACEVPIKSMMSSAVTLLTPRHVAVIGAGAAGLVAARELRREGHRVVVFEKGEEVGGMWVYSPEVDSDPLGLEAKRRLVHSSLYDSLRTNLSRESMSFRDYPFRRREGKGRDSRRFPGHREELLYLQDFAAEFEIGELVRFGTEVLFAGLDQCGKWRLTSTSPHTHPVDEIYDALIICNGHYVQPRLPHIPGINAWPGKQMHSHNYRTPEPFQDQVVVLIGSSASAVDISRDIATVAKEVHIAARSVEEDKLGKVPGHENMWLHSMIDSVHEDGTVVFQDGNAVGADFIIHCTGYKYDFPFLETNGEVTVDDNRVGPLYKHVFPPALAPWLSFVGLPWKVAPFSLFELQSKWIAGILSNRIALPSKEEMAKDVDAFYSSLEASGTPKRYTHNMGILQWDYNNWIADQCGVPSIEEWRRQMYIATSKNRVLRPESYRDEWDDDDLVLQAQQDFANYLT

SEQ ID NO: 11557 - DNA, 1305 bp, Zea mays
  CDS (1)..(1305)
atgcggcggcgcgcggaggtggccgtggtgggcgcgggcgcggcggggctggtggccgcgcgcgagctgctccgcgagggccacaccgtgtccgtcttcgagaagtcaggccgcgtggggggcacctgggcgtacagtccgcgcgcggacgcggacccgctgggcagcgacccgggcgcccccggcgccgtgcacagcagcctgtatgcgtcgctgcgcaccaacctgccgcgcgagctcatgggcttctcgggcttcccgctggccgggcgggcgttcgccggcgatccgcgcacgttcccgggccaccgggaggtcctcgcctacctcgacgccttcgccgcggattccggcgtcgccccgcacgtcaggctccgagcccaagtgctgcgggtgaggccgctctgtccgggtcggggacagggggagaagtgggcggtggcgtggcgcggggaagacggcgacgtcgcggaggaggcattcgacgccgtcgtcgtctgcaatggccactgctcggtgcctctagtgcccaagatccgaggaattaacaagtggcggggaaagcaaatgcacagccacaattaccgcaccccggaaccattccgagatcagagtgttgtagtcgtaggattgggagccagcggaatcgacatcgctagagaaatctcacacgtggccaaggaggtgcacatctcagctagatactcggagggcaggctcggaaagattgaactctaccataacgcctggatgcacagcgagatagagtgcatccaagacgacggccaggtgcgctttgcccaaggctcatctgtggctgcagacaccattctttactgcacagggtaccgctaccattttccgttcctggacctggatgggttcaccgtggacgacaaccgcgtcgggccactgtacaagcacgtcttcccacccaagtatgcacccaatctctctttcgttgggctgccatacaagagcatcatcttccacgcactagagctggaatccaagtgggtcgccgccgtcctgtcggggcgtgccgagctgccggtggaggaggacatgacggccgacgtggaagaggagtaccagcgcatggaggacgccgggaagccgaagcgccacacccacacgctgtggcctcggtgggtggagtacctgaactgggtggcggaccaggtcggcgaggcgcacctggagcctaggaagtgcgagatgtatgagaaggcgctcaagtgcgtctggtccctcgacgagggctaccgtgatcgatgggaagaagaaagcattggcagtggctga

SEQ ID NO: 11558 - protein, 434 aa, Zea mays
MRRRAEVAVVGAGAAGLVAARELLREGHTVSVFEKSGRVGGTWAYSPRADADPLGSDPGAPGAVHSSLYASLRTNLPRELMGFSGFPLAGRAFAGDPRTFPGHREVLAYLDAFAADSGVAPHVRLRAQVLRVRPLCPGRGQGEKWAVAWRGEDGDVAEEAFDAVVVCNGHCSVPLVPKIRGINKWRGKQMHSHNYRTPEPFRDQSVVVVGLGASGIDIAREISHVAKEVHISARYSEGRLGKIELYHNAWMHSEIECIQDDGQVRFAQGSSVAADTILYCTGYRYHFPFLDLDGFTVDDNRVGPLYKHVFPPKYAPNLSFVGLPYKSIIFHALELESKWVAAVLSGRAELPVEEDMTADVEEEYQRMEDAGKPKRHTHTLWPRWVEYLNWVADQVGEAHLEPRKCEMYEKALKCVWSLDEGYRDRWEEESIGSG

SEQ ID NO: 11559 - DNA, 27 bp, Artificial sequence
  primer
atgacagtgaatgacaaaaaaagattg

SEQ ID NO: 11560 - DNA, 25 bp, Artificial sequence
  primer
tcagtagttcctgtagttctgcata

SEQ ID NO: 11561 - protein, 470 aa, Artificial sequence
  consensus sequence
  Variant (3)..(3): Xaa in position 3 is any amino acid
  Variant (5)..(6): Xaa in position 5 to 6 is any amino acid
  Variant (9)..(13): Xaa in position 9 to 13 is any amino acid
  Variant (15)..(24): Xaa in position 15 to 24 is any amino acid
  Variant (25)..(30): Xaa in position 25 to 30 is any or no amino acid
  Variant (32)..(36): Xaa in position 32 to 36 is any amino acid
  Variant (39)..(39): Xaa in position 39 is any amino acid
  Variant (40)..(40): Xaa in position 40 is any or no amino acid
  Variant (42)..(42): Xaa in position 42 is any amino acid
  Variant (44)..(52): Xaa in position 44 to 52 is any amino acid
  Variant (53)..(88): Xaa in position 53 to 88 is any or no amino acid
  Variant (90)..(91): Xaa in position 90 to 91 is any amino acid
  Variant (93)..(100): Xaa in position 93 to 100 is any amino acid
  Variant (102)..(107): Xaa in position 102 to 107 is any amino acid
  Variant (109)..(114): Xaa in position 109 to 114 is any amino acid
  Variant (115)..(123): Xaa in position 115 to 123 is any or no amino acid
  Variant (125)..(131): Xaa in position 125 to 131 is any amino acid
  Variant (133)..(149): Xaa in position 133 to 149 is any amino acid
  Variant (150)..(154): Xaa in position 150 to 154 is any or no amino acid
  Variant (156)..(164): Xaa in position 156 to 164 is any amino acid
  Variant (165)..(173): Xaa in position 165 to 173 is any or no amino acid
  Variant (175)..(175): Xaa in position 175 is any amino acid
  Variant (177)..(187): Xaa in position 177 to 187 is any amino acid
  Variant (188)..(196): Xaa in position 188 to 196 is any or no amino acid
  Variant (198)..(198): Xaa in position 198 is any amino acid
  Variant (200)..(203): Xaa in position 200 to 203 is any amino acid
  Variant (206)..(208): Xaa in position 206 to 208 is any amino acid
  Variant (210)..(215): Xaa in position 210 to 215 is any amino acid
  Variant (216)..(216): Xaa in position 216 is any or no amino acid
  Variant (218)..(225): Xaa in position 218 to 225 is any amino acid
  Variant (226)..(230): Xaa in position 226 to 230 is any or no amino acid
  Variant (233)..(245): Xaa in position 233 to 245 is any amino acid
  Variant (247)..(247): Xaa in position 247 is any amino acid
  Variant (249)..(249): Xaa in position 249 is any amino acid
  Variant (251)..(253): Xaa in position 251 to 253 is any amino acid
  Variant (255)..(256): Xaa in position 255 to 256 is any amino acid
  Variant (259)..(305): Xaa in position 259 to 305 is any amino acid
  Variant (306)..(311): Xaa in position 306 to 311 is any or no amino acid
  Variant (313)..(317): Xaa in position 313 to 317 is any amino acid
  Variant (318)..(318): Xaa in position 318 is any or no amino acid
  Variant (320)..(323): Xaa in position 320 to 323 is any amino acid
  Variant (328)..(328): Xaa in position 328 is any amino acid
  Variant (330)..(331): Xaa in position 330 to 331 is any amino acid
  Variant (334)..(348): Xaa in position 334 to 348 is any amino acid
  Variant (349)..(359): Xaa in position 349 to 359 is any or no amino acid
  Variant (361)..(369): Xaa in position 361 to 369 is any amino acid
  Variant (370)..(370): Xaa in position 370 is any or no amino acid
  Variant (372)..(372): Xaa in position 372 is any amino acid
  Variant (374)..(374): Xaa in position 374 is any amino acid
  Variant (376)..(384): Xaa in position 376 to 384 is any amino acid
  Variant (386)..(388): Xaa in position 386 to 388 is any amino acid
  Variant (390)..(390): Xaa in position 390 is any amino acid
  Variant (392)..(400): Xaa in position 392 to 400 is any amino acid
  Variant (402)..(404): Xaa in position 402 to 404 is any amino acid
  Variant (407)..(424): Xaa in position 407 to 424 is any amino acid
  Variant (425)..(469): Xaa in position 425 to 469 is any or no amino acid
IGXGXXGLXXXXXLXXXXXXXXXXXXXXXXEXXXXXGGXXWXYXXXXXXXXXXXXXXXXXXXXXXXXXXXXXXXXXXXXXXXXXXXXXYXXLXXXXXXXXMXXXXXXFXXXXXXXXXXXXXXXPXXXXXXXYXXXXXXXXXXXXXXXXXXXXXXVXXXXXXXXXXXXXXXXXXWXVXXXXXXXXXXXXXXXXXXXXDXVXXXXGHXXXPXXXXXXXGXXXXXXXXXXXXXHSXXXXXXXXXXXXXVXVXGXXXSXXDIXXXXXXXXXXXXXXXXXXXXXXXXXXXXXXXXXXXXXXXXXXXXXXXXXXXXXGXXXXXXDXXXXCTGYXYXXPFXXXXXXXXXXXXXXXXXXXXXXXXXXLXXXXXXXXXXPXLXFXXXXXXXXXFXXXEXQXXXXXXXXXGXXXLPXXXXXXXXXXXXXXXXXXXXXXXXXXXXXXXXXXXXXXXXXXXXXXXXXXXXXXXXXXXXXXXW

SEQ ID NO: 11562 - protein, 32 aa, Artificial sequence
  protein pattern
  Variant (3)..(3): Xaa in position 3 is His or Lys
  Variant (4)..(4): Xaa in position 4 is any amino acid
  Variant (5)..(5): Xaa in position 5 is Phe or Tyr
  Variant (6)..(15): Xaa in position 6 to 15 is any amino acid
  Variant (16)..(16): Xaa in position 16 is Ile or Val
  Variant (17)..(19): Xaa in position 17 to 19 is Ile, Leu or Val
  Variant (21)..(23): Xaa in position 21 to 23 is any amino acid
  Variant (25)..(25): Xaa in position 25 is Ala or Gly
  Variant (26)..(26): Xaa in position 26 is any amino acid
  Variant (27)..(27): Xaa in position 27 is Asp or Glu
  Variant (28)..(28): Xaa in position 28 is Ile or Val
  Variant (29)..(29): Xaa in position 29 is Ala, Cys, Gly or Ser
  Variant (30)..(30): Xaa in position 30 is any amino acid
  Variant (31)..(31): Xaa in position 31 is Asp, Glu, Gly or Gln
  Variant (32)..(32): Xaa in position 32 is Ile or Leu
HSXXXXXXXXXXXXXXXXXGXXXSXXXXXXXX

SEQ ID NO: 11563 - protein, 14 aa, Artificial sequence
  protein pattern
  Variant (3)..(3): Xaa in position 3 is Ala or Gly
  Variant (5)..(5): Xaa in position 5 is Ala or Pro
  Variant (6)..(6): Xaa in position 6 is Ala, Cys, Gly, Ser or Thr
  Variant (9)..(9): Xaa in position 9 is Ala, Thr or Val
  Variant (10)..(10): Xaa in position 10 is Ala, Gln, Ser or Thr
  Variant (11)..(11): Xaa in position 11 is any amino acid
  Variant (12)..(12): Xaa in position 12 is Lys or Arg
  Variant (13)..(13): Xaa in position 13 is any amino acid
  Variant (14)..(14): Xaa in position 14 is Phe or Leu
IGXGXXGLXXXXXX

SEQ ID NO: 11564 - DNA, 2871 bp, Escherichia coli
  CDS (1)..(2871): transl_table=11
atgatcatccactttactttaaatggcgcgcctcaggagctaaccgttaatccaggcgaaaacgtgcaaaagctgttgtttaacatgggaatgcactctgtacgcaacagtgatgatggtttcgggtttgccggttctgacgcaataatctttaacggtaatatcgttaacgcgtccttgcttattgccgcacagttagagaaggcagatattcgtaccgcagaatctctgggcaaatggaacgagttaagtctggttcaacaggcaatggttgatgttggcgtggtgcagtctggttataacgatccagctgcagctctgattatcaccgatcttctcgatcgcatcgccgcacctacccgcgaagagatcgacgacgcgctttctggtttgttcagccgcgatgctggctggcagcaatactatcaggtcattgaactggcggttgcacgtaaaaataatccgcaggccaccattgatatcgctccgactttccgtgacgacctagaagtcattggtaagcattatcctaaaactgatgccgcgaaaatggtgcaggcgaaaccctgctatgttgaagaccgcgtaacggctgacgcctgcgtcattaaaatgttacgtagcccacacgctcacgcactgattactcatctggatgtcagcaaagctgaagccttaccgggcgtcgttcacgttattactcacctgaattgcccggatatctactataccccgggtggtcagagcgcaccggaaccgtcaccgcttgaccgccgtatgttcggcaagaaaatgcgtcacgtcggcgatcgtgttgctgcggtcgtcgcagaaagtgaagaaattgcgctcgaagcactgaagctcatcgacgttgaatatgaagtgcttaagccggtaatgtcgatcgacgaagcaatggcggaagatgcgcctgtcgtgcacgatgaaccggtggtgtatgttgctggtgcgccagatactctggaagacgataacagccatgcagcccagcgcggcgagcatatgatcatcaacttcccgatcggttctcgccctcgcaaaaatatcgccgccagtattcatggtcatattggcgatatggacaaaggctttgccgatgccgatgtgatcattgagcgaacctataactcaacgcaagcgcagcagtgcccgactgaaacacatatctgctttactcgtatggacggcgatcgtctggttatccacgcctccacccaggtaccatggcacttacgccgccaggtcgcgcgcctcgtgggcatgaaacagcataaagttcatgtcattaaagagcgagttggcggcggttttggttccaaacaggacatcctgctggaagaagtgtgcgcctgggcaacctgcgtgaccgggcgtccggtactgttccgctacacccgtgaagaagagtttattgctaacacctctcgtcacgtcgcgaaagtcaccgtcaaactgggagcgaaaaaagatggtcgcctgacggcagtgaagatggatttccgcgccaacactggcccttacggcaaccactcactcaccgtaccgtgtaacggaccggcgctgtcgctgccgttatatccgtgcgataacgtcgatttccaggtcaccacctactacagcaacatttgcccaaatggtgcttatcagggttatggcgcaccgaaaggtaacttcgctatcaccatggcattagcggaactggctgaacagttacagatcgaccaactggaaattatcgaacgtaaccgggcacacgaagggcaagagctgaaaattctcggtgcaatcggtgaaggtaaagcgccgacctccgttccttccgccgccagctgtgcactggaagagatcctgcgtcagggtcgcgagatgatccaatggtcgtcaccgaaaccgcaaaatggtgactggcacatcggtcgcggcgtcgccattatcatgcagaaatcgggtatcccggatatcgatcaggctaactgcatgatcaaactggaatcggacggcacctttatcgttcattctggcggtgcggatattggtactggtctggatactgtagtgacgaaactggcagcagaagtgctgcactgcccaccgcaggacgtgcatgttatctccggtgataccgatcatgcgttgtttgataaaggcgcatatgcctcgtccggtacttgcttctcgggtaacgcggcgcgtttggcagcggaaaatctacgggagaaaattctgttccacggcgcgcaaatgttgggtgagccagtggcagatgttcaactggcaacgccgggtgtcgtgcgcggcaagaaaggcgaagttagtttcggggatattgcccataaaggcgaaaccggcaccggctttggttcactggtgggaactggcagttatatcacgcctgatttcgccttcccgtatggcgcaaacttcgctgaagttgccgtcaacacgcgtacgggtgaaatccgcctggataaattctacgccttgctggactgcggtacaccggtcaatccagagttagcgttgggacaaatctacggtgccaccctgcgtgctatcggccacagtatgagcgaagagatcatttatgacgccgaaggtcacccgttaacgcgtgatttacgcagttacggcgcaccgaaaattggtgacattccgcgtgatttccgcgctgtgctggtgccgagcgacgataaagtcggcccgttcggggcgaaatcgatctcggaaatcggtgtaaatggcgcagctccggcgattgctaccgcaattcacgatgcatgcagcatctggttacgcgaatggcatttcacaccggagaaaatactcactgcgctggaaaaaatataa

SEQ ID NO: 11565 - protein, 956 aa, Escherichia coli
MIIHFTLNGAPQELTVNPGENVQKLLFNMGMHSVRNSDDGFGFAGSDAIIFNGNIVNASLLIAAQLEKADIRTAESLGKWNELSLVQQAMVDVGVVQSGYNDPAAALIITDLLDRIAAPTREEIDDALSGLFSRDAGWQQYYQVIELAVARKNNPQATIDIAPTFRDDLEVIGKHYPKTDAAKMVQAKPCYVEDRVTADACVIKMLRSPHAHALITHLDVSKAEALPGVVHVITHLNCPDIYYTPGGQSAPEPSPLDRRMFGKKMRHVGDRVAAVVAESEEIALEALKLIDVEYEVLKPVMSIDEAMAEDAPVVHDEPVVYVAGAPDTLEDDNSHAAQRGEHMIINFPIGSRPRKNIAASIHGHIGDMDKGFADADVIIERTYNSTQAQQCPTETHICFTRMDGDRLVIHASTQVPWHLRRQVARLVGMKQHKVHVIKERVGGGFGSKQDILLEEVCAWATCVTGRPVLFRYTREEEFIANTSRHVAKVTVKLGAKKDGRLTAVKMDFRANTGPYGNHSLTVPCNGPALSLPLYPCDNVDFQVTTYYSNICPNGAYQGYGAPKGNFAITMALAELAEQLQIDQLEIIERNRAHEGQELKILGAIGEGKAPTSVPSAASCALEEILRQGREMIQWSSPKPQNGDWHIGRGVAIIMQKSGIPDIDQANCMIKLESDGTFIVHSGGADIGTGLDTVVTKLAAEVLHCPPQDVHVISGDTDHALFDKGAYASSGTCFSGNAARLAAENLREKILFHGAQMLGEPVADVQLATPGVVRGKKGEVSFGDIAHKGETGTGFGSLVGTGSYITPDFAFPYGANFAEVAVNTRTGEIRLDKFYALLDCGTPVNPELALGQIYGATLRAIGHSMSEEIIYDAEGHPLTRDLRSYGAPKIGDIPRDFRAVLVPSDDKVGPFGAKSISEIGVNGAAPAIATAIHDACSIWLREWHFTPEKILTALEKI

SEQ ID NO: 11566 - DNA, 2871 bp, Escherichia coli; identical to SEQ ID NO: 6949
  CDS (1)..(2871): transl_table=11

SEQ ID NO: 11567 - protein, 956 aa, Escherichia coli; identical to SEQ ID NO: 6950

SEQ ID NO: 11568 - DNA, 4086 bp, Arabidopsis thaliana; identical to SEQ ID NO: 6951
  CDS (1)..(4086)

SEQ ID NO: 11569 - protein, 1361 aa, Arabidopsis thaliana; identical to SEQ ID NO: 6952

SEQ ID NO: 11570 - DNA, 4062 bp, Arabidopsis thaliana; identical to SEQ ID NO: 6953
  CDS (1)..(4062)

SEQ ID NO: 11571 - protein, 1353 aa, Arabidopsis thaliana; identical to SEQ ID NO: 6954

SEQ ID NO: 11572 - DNA, 2724 bp, Bradyrhizobium japonicum USDA 110; identical to SEQ ID NO: 6955
  CDS (1)..(2724): transl_table=11

SEQ ID NO: 11573 - protein, 907 aa, Bradyrhizobium japonicum USDA 110; identical to SEQ ID NO: 6956

SEQ ID NO: 11574 - DNA, 4071 bp, Apis mellifera; identical to SEQ ID NO: 6957
  CDS (1)..(4071)

SEQ ID NO: 11575 - protein, 1356 aa, Apis mellifera; identical to SEQ ID NO: 6958

SEQ ID NO: 11576 - DNA, 3741 bp, Strongylocentrotus purpuratus; identical to SEQ ID NO: 6959
  CDS (1)..(3741)

SEQ ID NO: 11577 - protein, 1246 aa, Strongylocentrotus purpuratus; identical to SEQ ID NO: 6960

SEQ ID NO: 11578 - DNA, 3978 bp, Magnaporthe grisea 70-15; identical to SEQ ID NO: 6961
  CDS (1)..(3978)

SEQ ID NO: 11579 - protein, 1325 aa, Magnaporthe grisea 70-15; identical to SEQ ID NO: 6962

SEQ ID NO: 11580 - DNA, 4068 bp, Nasonia vitripennis; identical to SEQ ID NO: 6963
  CDS (1)..(4068)

SEQ ID NO: 11581 - protein, 1355 aa, Nasonia vitripennis; identical to SEQ ID NO: 6964

SEQ ID NO: 11582 - DNA, 4080 bp, Nasonia vitripennis; identical to SEQ ID NO: 6965
  CDS (1)..(4080)

SEQ ID NO: 11583 - protein, 1359 aa, Nasonia vitripennis; identical to SEQ ID NO: 6966

SEQ ID NO: 11584 - DNA, 3990 bp, Anopheles gambiae str. PEST; identical to SEQ ID NO: 6967
  CDS (1)..(3990)

SEQ ID NO: 11585 - protein, 1329 aa, Anopheles gambiae str. PEST; identical to SEQ ID NO: 6968

SEQ ID NO: 11586 - DNA, 4107 bp, Gibberella zeae PH-1; identical to SEQ ID NO: 6969
  CDS (1)..(4107)

SEQ ID NO: 11587 - protein, 1368 aa, Gibberella zeae PH-1; identical to SEQ ID NO: 6970

SEQ ID NO: 11588 - DNA, 4383 bp, Ustilago maydis 521; identical to SEQ ID NO: 6971
  CDS (1)..(4383)

SEQ ID NO: 11589 - protein, 1460 aa, Ustilago maydis 521; identical to SEQ ID NO: 6972

SEQ ID NO: 11590 - DNA, 2715 bp, Bradyrhizobium sp. ORS278; identical to SEQ ID NO: 6973
  CDS (1)..(2715): transl_table=11

SEQ ID NO: 11591 - protein, 904 aa, Bradyrhizobium sp. ORS278; identical to SEQ ID NO: 6974

SEQ ID NO: 11592 - DNA, 2751 bp, Kineococcus radiotolerans SRS30216; identical to SEQ ID NO: 6975
  CDS (1)..(2751): transl_table=11

SEQ ID NO: 11593 - protein, 916 aa, Kineococcus radiotolerans SRS30216; identical to SEQ ID NO: 6976

SEQ ID NO: 11594 - DNA, 2736 bp, Xanthobacter autotrophicus Py2; identical to SEQ ID NO: 6977
  CDS (1)..(2736): transl_table=11

SEQ ID NO: 11595 - protein, 911 aa, Xanthobacter autotrophicus Py2; identical to SEQ ID NO: 6978

SEQ ID NO: 11596 - DNA, 2721 bp, Desulfovibrio vulgaris subsp. vulgaris str. Hildenborough; identical to SEQ ID NO: 6979
  CDS (1)..(2721): transl_table=11

SEQ ID NO: 11597 - protein, 906 aa, Desulfovibrio vulgaris subsp. vulgaris str. Hildenborough; identical to SEQ ID NO: 6980

SEQ ID NO: 11598 - DNA, 2748 bp, Silicibacter pomeroyi DSS-3; identical to SEQ ID NO: 6981
  CDS (1)..(2748): transl_table=11

SEQ ID NO: 11599 - protein, 915 aa, Silicibacter pomeroyi DSS-3; identical to SEQ ID NO: 6982

SEQ ID NO: 11600 - DNA, 2724 bp, Desulfovibrio desulfuricans G20; identical to SEQ ID NO: 6983
  CDS (1)..(2724): transl_table=11

SEQ ID NO: 11601 - protein, 907 aa, Desulfovibrio desulfuricans G20; identical to SEQ ID NO: 6984

SEQ ID NO: 11602 - DNA, 2712 bp, Rhodococcus sp. RHA1; identical to SEQ ID NO: 6985
  CDS (1)..(2712): transl_table=11

SEQ ID NO: 11603 - protein, 903 aa, Rhodococcus sp. RHA1; identical to SEQ ID NO: 6986

SEQ ID NO: 11604 - DNA, 2718 bp, Rhodococcus sp. RHA1; identical to SEQ ID NO: 6987
  CDS (1)..(2718): transl_table=11

SEQ ID NO: 11605 - protein, 905 aa, Rhodococcus sp. RHA1; identical to SEQ ID NO: 6988

SEQ ID NO: 11606 - DNA, 2682 bp, Mycobacterium smegmatis str. MC2 155; identical to SEQ ID NO: 6989
  CDS (1)..(2682): transl_table=11

SEQ ID NO: 11607 - protein, 893 aa, Mycobacterium smegmatis str. MC2 155; identical to SEQ ID NO: 6990

SEQ ID NO: 11608 - DNA, 2919 bp, Nocardioides sp. JS614; identical to SEQ ID NO: 6991
  CDS (1)..(2919): transl_table=11

SEQ ID NO: 11609 - protein, 972 aa, Nocardioides sp. JS614; identical to SEQ ID NO: 6992

SEQ ID NO: 11610 - DNA, 2748 bp, Sulfitobacter sp. EE-36; identical to SEQ ID NO: 6993
  CDS (1)..(2748): transl_table=11

SEQ ID NO: 11611 - protein, 915 aa, Sulfitobacter sp. EE-36; identical to SEQ ID NO: 6994

SEQ ID NO: 11612 - DNA, 2742 bp, Roseovarius nubinhibens ISM; identical to SEQ ID NO: 6995
  CDS (1)..(2742): transl_table=11

SEQ ID NO: 11613 - protein, 913 aa, Roseovarius nubinhibens ISM; identical to SEQ ID NO: 6996

SEQ ID NO: 11614 - DNA, 2871 bp, Escherichia coli B; identical to SEQ ID NO: 6997
  CDS (1)..(2871): transl_table=11

SEQ ID NO: 11615 - protein, 956 aa, Escherichia coli B; identical to SEQ ID NO: 6998

SEQ ID NO: 11616 - DNA, 2796 bp, Streptomyces cinnamonensis; identical to SEQ ID NO: 6999
  CDS (1)..(2796): transl_table=11

SEQ ID NO: 11617 - protein, 931 aa, Streptomyces cinnamonensis; identical to SEQ ID NO: 7000

SEQ ID NO: 11618 - DNA, 3771 bp, Oryza sativa subsp; identical to SEQ ID NO: 7001
  CDS (1)..(3771)

SEQ ID NO: 11619 - protein, 1256 aa, Oryza sativa subsp; identical to SEQ ID NO: 7002

SEQ ID NO: 11620 - DNA, 4245 bp, Oryza sativa subsp; identical to SEQ ID NO: 7003
  CDS (1)..(4245)

SEQ ID NO: 11621 - protein, 1414 aa, Oryza sativa subsp; identical to SEQ ID NO: 7004

SEQ ID NO: 11622 - DNA, 4056 bp, Oryza sativa subsp; identical to SEQ ID NO: 7005
  CDS (1)..(4056)

SEQ ID NO: 11623 - protein, 1351 aa, Oryza sativa subsp; identical to SEQ ID NO: 7006

SEQ ID NO: 11624 - DNA, 4071 bp, Oryza sativa subsp; identical to SEQ ID NO: 7007
  CDS (1)..(4071)

SEQ ID NO: 11625 - protein, 1356 aa, Oryza sativa subsp; identical to SEQ ID NO: 7008

SEQ ID NO: 11626 - DNA, 3846 bp, Vitis vinifera; identical to SEQ ID NO: 7009
  CDS (1)..(3846)

SEQ ID NO: 11627 - protein, 1281 aa, Vitis vinifera; identical to SEQ ID NO: 7010

SEQ ID NO: 11628 - DNA, 3807 bp, Vitis vinifera; identical to SEQ ID NO: 7011
  CDS (1)..(3807)

SEQ ID NO: 11629 - protein, 1268 aa, Vitis vinifera; identical to SEQ ID NO: 7012

SEQ ID NO: 11630 - DNA, 3894 bp, Vitis vinifera; identical to SEQ ID NO: 7013
  CDS (1)..(3894)

SEQ ID NO: 11631 - protein, 1297 aa, Vitis vinifera; identical to SEQ ID NO: 7014

SEQ ID NO: 11632 - DNA, 4077 bp, Zea mays; identical to SEQ ID NO: 7015
  CDS (1)..(4077)

SEQ ID NO: 11633 - protein, 1358 aa, Zea mays; identical to SEQ ID NO: 7016

SEQ ID NO: 11634 - DNA, 4050 bp, Zea mays; identical to SEQ ID NO: 7017
  CDS (1)..(4050)

SEQ ID NO: 11635 - protein, 1349 aa, Zea mays; identical to SEQ ID NO: 7018

SEQ ID NO: 11636 - DNA, 3990 bp, Phaeosphaeria nodorum; identical to SEQ ID NO: 7019
  CDS (1)..(3990)

SEQ ID NO: 11637 - protein, 1329 aa, Phaeosphaeria nodorum; identical to SEQ ID NO: 7020

SEQ ID NO: 11638 - DNA, 4473 bp, Phaeosphaeria nodorum; identical to SEQ ID NO: 7021
  CDS (1)..(4473)

SEQ ID NO: 11639 - protein, 1490 aa, Phaeosphaeria nodorum; identical to SEQ ID NO: 7022

SEQ ID NO: 11640 - DNA, 4083 bp, Brassica campestris; identical to SEQ ID NO: 7023
  CDS (1)..(4083)

SEQ ID NO: 11641 - protein, 1360 aa, Brassica campestris; identical to SEQ ID NO: 7024

SEQ ID NO: 11642 - DNA, 4083 bp, Lactuca sativa; identical to SEQ ID NO: 7025
  CDS (1)..(4083)

SEQ ID NO: 11643 - protein, 1360 aa, Lactuca sativa; identical to SEQ ID NO: 7026

SEQ ID NO: 11644 - DNA, 4080 bp, Aspergillus oryzae; identical to SEQ ID NO: 7027
  CDS (1)..(4080)

SEQ ID NO: 11645 - protein, 1359 aa, Aspergillus oryzae; identical to SEQ ID NO: 7028

SEQ ID NO: 11646 - DNA, 3060 bp, uncultured bacterium; identical to SEQ ID NO: 7029
  CDS (1)..(3060): transl_table=11

SEQ ID NO: 11647 - protein, 1019 aa, uncultured bacterium; identical to SEQ ID NO: 7030

SEQ ID NO: 11648 - DNA, 4062 bp, Arabidopsis thaliana; identical to SEQ ID NO: 7031
  CDS (1)..(4062)

SEQ ID NO: 11649 - protein, 1353 aa, Arabidopsis thaliana; identical to SEQ ID NO: 7032

SEQ ID NO: 11650 - DNA, 2763 bp, uncultured bacterium 582; identical to SEQ ID NO: 7033
  CDS (1)..(2763): transl_table=11

SEQ ID NO: 11651 - protein, 920 aa, uncultured bacterium 582; identical to SEQ ID NO: 7034

SEQ ID NO: 11652 - DNA, 3978 bp, Anopheles gambiae; identical to SEQ ID NO: 7035
  CDS (1)..(3978)

SEQ ID NO: 11653 - protein, 1325 aa, Anopheles gambiae; identical to SEQ ID NO: 7036

SEQ ID NO: 11654 - DNA, 4095 bp, Neurospora crassa; identical to SEQ ID NO: 7037
  CDS (1)..(4095)

SEQ ID NO: 11655 - protein, 1364 aa, Neurospora crassa; identical to SEQ ID NO: 7038

SEQ ID NO: 11656 - DNA, 4095 bp, Solanum lycopersicum; identical to SEQ ID NO: 7039
  CDS (1)..(4095)

SEQ ID NO: 11657 - protein, 1364 aa, Solanum lycopersicum; identical to SEQ ID NO: 7040

SEQ ID NO: 11658 - DNA, 4104 bp, Solanum lycopersicum; identical to SEQ ID NO: 7041
  CDS (1)..(4104)

SEQ ID NO: 11659 - protein, 1367 aa, Solanum lycopersicum; identical to SEQ ID NO: 7042

SEQ ID NO: 11660 - DNA, 4086 bp, Solanum lycopersicum; identical to SEQ ID NO: 7043
  CDS (1)..(4086)

SEQ ID NO: 11661 - protein, 1361 aa, Solanum lycopersicum; identical to SEQ ID NO: 7044

SEQ ID NO: 11662 - DNA, 4095 bp, Arabidopsis thaliana; identical to SEQ ID NO: 7045
  CDS (1)..(4095)

SEQ ID NO: 11663 - protein, 1364 aa, Arabidopsis thaliana; identical to SEQ ID NO: 7046

SEQ ID NO: 11664 - DNA, 4080 bp, Arabidopsis thaliana; identical to SEQ ID NO: 7047
  CDS (1)..(4080)

SEQ ID NO: 11665 - protein, 1359 aa, Arabidopsis thaliana; identical to SEQ ID NO: 7048

SEQ ID NO: 11666 - DNA, 4077 bp, Oryza sativa subsp; identical to SEQ ID NO: 7049
  CDS (1)..(4077)

SEQ ID NO: 11667 - protein, 1358 aa, Oryza sativa subsp; identical to SEQ ID NO: 7050

SEQ ID NO: 11668 - DNA, 3966 bp, Arabidopsis thaliana; identical to SEQ ID NO: 7051
  CDS (1)..(3966)

SEQ ID NO: 11669 - protein, 1321 aa, Arabidopsis thaliana; identical to SEQ ID NO: 7052

SEQ ID NO: 11670 - DNA, 4068 bp, Oryza sativa subsp; identical to SEQ ID NO: 7053
  CDS (1)..(4068)

SEQ ID NO: 11671 - protein, 1355 aa, Oryza sativa subsp; identical to SEQ ID NO: 7054

SEQ ID NO: 11672 - DNA, 3999 bp, Arabidopsis thaliana; identical to SEQ ID NO: 7055
  CDS (1)..(3999)

SEQ ID NO: 11673 - protein, 1332 aa, Arabidopsis thaliana; identical to SEQ ID NO: 7056

SEQ ID NO: 11674 - DNA, 4071 bp, Oryza sativa subsp; identical to SEQ ID NO: 7057
  CDS (1)..(4071)

SEQ ID NO: 11675 - protein, 1356 aa, Oryza sativa subsp; identical to SEQ ID NO: 7058

SEQ ID NO: 11676 - DNA, 4014 bp, Arabidopsis thaliana; identical to SEQ ID NO: 7059
  CDS (1)..(4014)

SEQ ID NO: 11677 - protein, 1337 aa, Arabidopsis thaliana; identical to SEQ ID NO: 7060

SEQ ID NO: 11678 - DNA, 2724 bp, Desulfovibrio gigas; identical to SEQ ID NO: 7061
  CDS (1)..(2724): transl_table=11

SEQ ID NO: 11679 - protein, 907 aa, Desulfovibrio gigas; identical to SEQ ID NO: 7062

SEQ ID NO: 11680 - DNA, 2871 bp, Escherichia coli O157; identical to SEQ ID NO: 7063
  CDS (1)..(2871): transl_table=11
  misc_feature (1695)..(1695): y is t or c

SEQ ID NO: 11681 - protein, 956 aa, Escherichia coli O157; identical to SEQ ID NO: 7064

SEQ ID NO: 11682 - DNA, 4008 bp, Drosophila melanogaster; identical to SEQ ID NO: 7065
  CDS (1)..(4008)

SEQ ID NO: 11683 - protein, 1335 aa, Drosophila melanogaster; identical to SEQ ID NO: 7066

SEQ ID NO: 11684 - DNA, 4035 bp, Drosophila subobscura; identical to SEQ ID NO: 7067
  CDS (1)..(4035)

SEQ ID NO: 11685 - protein, 1344 aa, Drosophila subobscura; identical to SEQ ID NO: 7068

SEQ ID NO: 11686 - DNA, 4059 bp, Zea mays; identical to SEQ ID NO: 7069
  CDS (1)..(4059)

SEQ ID NO: 11687 - protein, 1352 aa, Zea mays; identical to SEQ ID NO: 7070

SEQ ID NO: 11688 - DNA, 4050 bp, Zea mays; identical to SEQ ID NO: 7071
  CDS (1)..(4050)

SEQ ID NO: 11689 - protein, 1349 aa, Zea mays; identical to SEQ ID NO: 7072

SEQ ID NO: 11690 - DNA, 26 bp, Artificial sequence
  primer
atgatcatccactttactttaaatgg

SEQ ID NO: 11691 - DNA, 25 bp, Artificial sequence
  primer
ttatattttttccagcgcagtgagt

SEQ ID NO: 11692 - protein, 1609 aa, Artificial sequence; identical to SEQ ID NO: 7075
  consensus sequence
  Variant (2)..(4): Xaa in position 2 to 4 is any amino acid
  Variant (7)..(11): Xaa in position 7 to 11 is any amino acid
  Variant (12)..(14): Xaa in position 12 to 14 is any or no amino acid
  Variant (16)..(16): Xaa in position 16 is any amino acid
  Variant (17)..(17): Xaa in position 17 is any or no amino acid
  Variant (19)..(20): Xaa in position 19 to 20 is any amino acid
  Variant (22)..(22): Xaa in position 22 is any amino acid
  Variant (23)..(40): Xaa in position 23 to 40 is any or no amino acid
  Variant (45)..(45): Xaa in position 45 is any amino acid
  Variant (47)..(49): Xaa in position 47 to 49 is any amino acid
  Variant (50)..(78): Xaa in position 50 to 78 is any or no amino acid
  Variant (81)..(88): Xaa in position 81 to 88 is any amino acid
  Variant (89)..(93): Xaa in position 89 to 93 is any or no amino acid
  Variant (95)..(95): Xaa in position 95 is any amino acid
  Variant (98)..(98): Xaa in position 98 is any amino acid
  Variant (100)..(102): Xaa in position 100 to 102 is any amino acid
  Variant (103)..(105): Xaa in position 103 to 105 is any or no amino acid
  Variant (107)..(115): Xaa in position 107 to 115 is any amino acid
  Variant (116)..(118): Xaa in position 116 to 118 is any or no amino acid
  Variant (127)..(130): Xaa in position 127 to 130 is any amino acid
  Variant (131)..(168): Xaa in position 131 to 168 is any or no amino acid
  Variant (170)..(171): Xaa in position 170 to 171 is any amino acid
  Variant (181)..(181): Xaa in position 181 is any amino acid
  Variant (183)..(206): Xaa in position 183 to 206 is any amino acid
  Variant (207)..(703): Xaa in position 207 to 703 is any or no amino acid
  Variant (705)..(709): Xaa in position 705 to 709 is any amino acid
  Variant (711)..(713): Xaa in position 711 to 713 is any amino acid
  Variant (715)..(716): Xaa in position 715 to 716 is any amino acid
  Variant (718)..(723): Xaa in position 718 to 723 is any amino acid
  Variant (724)..(728): Xaa in position 724 to 728 is any or no amino acid
  Variant (730)..(735): Xaa in position 730 to 735 is any amino acid
  Variant (737)..(740): Xaa in position 737 to 740 is any amino acid
  Variant (742)..(751): Xaa in position 742 to 751 is any amino acid
  Variant (752)..(757): Xaa in position 752 to 757 is any or no amino acid
  Variant (759)..(765): Xaa in position 759 to 765 is any amino acid
  Variant (767)..(767): Xaa in position 767 is any amino acid
  Variant (769)..(788): Xaa in position 769 to 788 is any amino acid
  Variant (789)..(800): Xaa in position 789 to 800 is any or no amino acid
  Variant (802)..(808): Xaa in position 802 to 808 is any amino acid
  Variant (810)..(814): Xaa in position 810 to 814 is any amino acid
  Variant (816)..(817): Xaa in position 816 to 817 is any amino acid
  Variant (819)..(825): Xaa in position 819 to 825 is any amino acid
  Variant (827)..(837): Xaa in position 827 to 837 is any amino acid
  Variant (838)..(840): Xaa in position 838 to 840 is any or no amino acid
  Variant (842)..(856): Xaa in position 842 to 856 is any amino acid
  Variant (857)..(900): Xaa in position 857 to 900 is any or no amino acid
  Variant (903)..(946): Xaa in position 903 to 946 is any amino acid
  Variant (947)..(950): Xaa in position 947 to 950 is any or no amino acid
  Variant (952)..(952): Xaa in position 952 is any amino acid
  Variant (954)..(954): Xaa in position 954 is any amino acid
  Variant (956)..(978): Xaa in position 956 to 978 is any amino acid
  Variant (979)..(988): Xaa in position 979 to 988 is any or no amino acid
  Variant (990)..(990): Xaa in position 990 is any amino acid
  Variant (998)..(1008): Xaa in position 998 to 1008 is any amino acid
  Variant (1009)..(1010): Xaa in position 1009 to 1010 is any or no amino acid
  Variant (1012)..(1016): Xaa in position 1012 to 1016 is any amino acid
  Variant (1020)..(1024): Xaa in position 1020 to 1024 is any amino acid
  Variant (1026)..(1033): Xaa in position 1026 to 1033 is any amino acid
  Variant (1034)..(1034): Xaa in position 1034 is any or no amino acid
  Variant (1038)..(1044): Xaa in position 1038 to 1044 is any amino acid
  Variant (1046)..(1049): Xaa in position 1046 to 1049 is any amino acid
  Variant (1051)..(1053): Xaa in position 1051 to 1053 is any amino acid
  Variant (1055)..(1061): Xaa in position 1055 to 1061 is any amino acid
  Variant (1063)..(1063): Xaa in position 1063 is any amino acid
  Variant (1065)..(1083): Xaa in position 1065 to 1083 is any amino acid
  Variant (1084)..(1084): Xaa in position 1084 is any or no amino acid
  Variant (1086)..(1097): Xaa in position 1086 to 1097 is any amino acid
  Variant (1098)..(1098): Xaa in position 1098 is any or no amino acid
  Variant (1101)..(1104): Xaa in position 1101 to 1104 is any amino acid
  Variant (1105)..(1105): Xaa in position 1105 is any or no amino acid
  Variant (1107)..(1107): Xaa in position 1107 is any amino acid
  Variant (1109)..(1110): Xaa in position 1109 to 1110 is any amino acid
  Variant (1112)..(1113): Xaa in position 1112 to 1113 is any amino acid
  Variant (1115)..(1119): Xaa in position 1115 to 1119 is any amino acid
  Variant (1121)..(1126): Xaa in position 1121 to 1126 is any amino acid
  Variant (1128)..(1129): Xaa in position 1128 to 1129 is any amino acid
  Variant (1131)..(1140): Xaa in position 1131 to 1140 is any amino acid
  Variant (1142)..(1188): Xaa in position 1142 to 1188 is any amino acid
  Variant (1189)..(1223): Xaa in position 1189 to 1223 is any or no amino acid
  Variant (1225)..(1255): Xaa in position 1225 to 1255 is any amino acid
  Variant (1256)..(1271): Xaa in position 1256 to 1271 is any or no amino acid
  Variant (1273)..(1274): Xaa in position 1273 to 1274 is any amino acid
  Variant (1276)..(1276): Xaa in position 1276 is any amino acid
  Variant (1280)..(1281): Xaa in position 1280 to 1281 is any amino acid
  Variant (1283)..(1285): Xaa in position 1283 to 1285 is any amino acid
  Variant (1286)..(1288): Xaa in position 1286 to 1288 is any or no amino acid
  Variant (1290)..(1291): Xaa in position 1290 to 1291 is any amino acid
  Variant (1293)..(1294): Xaa in position 1293 to 1294 is any amino acid
  Variant (1296)..(1308): Xaa in position 1296 to 1308 is any amino acid
  Variant (1309)..(1318): Xaa in position 1309 to 1318 is any or no amino acid
  Variant (1320)..(1330): Xaa in position 1320 to 1330 is any amino acid
  Variant (1332)..(1339): Xaa in position 1332 to 1339 is any amino acid
  Variant (1341)..(1402): Xaa in position 1341 to 1402 is any amino acid
  Variant (1403)..(1444): Xaa in position 1403 to 1444 is any or no amino acid
  Variant (1446)..(1450): Xaa in position 1446 to 1450 is any amino acid
  Variant (1453)..(1463): Xaa in position 1453 to 1463 is any amino acid
  Variant (1465)..(1465): Xaa in position 1465 is any amino acid
  Variant (1467)..(1469): Xaa in position 1467 to 1469 is any amino acid
  Variant (1472)..(1475): Xaa in position 1472 to 1475 is any amino acid
  Variant (1478)..(1478): Xaa in position 1478 is any amino acid
  Variant (1481)..(1483): Xaa in position 1481 to 1483 is any amino acid
  Variant (1486)..(1486): Xaa in position 1486 is any amino acid
  Variant (1488)..(1491): Xaa in position 1488 to 1491 is any amino acid
  Variant (1494)..(1497): Xaa in position 1494 to 1497 is any amino acid
  Variant (1498)..(1506): Xaa in position 1498 to 1506 is any or no amino acid
  Variant (1508)..(1509): Xaa in position 1508 to 1509 is any amino acid
  Variant (1510)..(1516): Xaa in position 1510 to 1516 is any or no amino acid
  Variant (1518)..(1519): Xaa in position 1518 to 1519 is any amino acid
  Variant (1521)..(1525): Xaa in position 1521 to 1525 is any amino acid
  Variant (1527)..(1529): Xaa in position 1527 to 1529 is any amino acid
  Variant (1530)..(1557): Xaa in position 1530 to 1557 is any or no amino acid
  Variant (1559)..(1560): Xaa in position 1559 to 1560 is any amino acid
  Variant (1563)..(1572): Xaa in position 1563 to 1572 is any amino acid
  Variant (1573)..(1582): Xaa in position 1573 to 1582 is any or no amino acid
  Variant (1584)..(1587): Xaa in position 1584 to 1587 is any amino acid
  Variant (1588)..(1608): Xaa in position 1588 to 1608 is any or no amino acid

SEQ ID NO: 11693 - protein, 11 aa, Artificial sequence
  protein pattern
  Variant (2)..(2): Xaa in position 2 is Ala, Gly or Thr
  Variant (3)..(3): Xaa in position 3 is any amino acid
  Variant (4)..(4): Xaa in position 4 is Asp or Glu
  Variant (5)..(5): Xaa in position 5 is Phe, Ile, Leu or Met
  Variant (7)..(7): Xaa in position 7 is Asn, Gln or Thr
  Variant (9)..(10): Xaa in position 9 to 10 is any amino acid
GXXXXGXGXXT

SEQ ID NO: 11694 - protein, 15 aa, Artificial sequence
  protein pattern
  Variant (2)..(4): Xaa in position 2 to 4 is any amino acid
  Variant (5)..(5): Xaa in position 5 is any or no amino acid
  Variant (7)..(7): Xaa in position 7 is any amino acid
  Variant (8)..(8): Xaa in position 8 is any or no amino acid
  Variant (11)..(11): Xaa in position 11 is Ala or Gly
  Variant (14)..(14): Xaa in position 14 is Gly or Ser
VXXXXRXXGGXFGXK

SEQ ID NO: 11695 - DNA, 1143 bp, Escherichia coli
  CDS (1)..(1143): transl_table=11
atgccgcatttggcactactcatctctaaaggagcaattatggaccgcattattcaatcaccgggtaaatacatccagggcgctgatgtgattaatcgtctgggcgaatacctgaagccgctggcagaacgctggttagtggtgggtgacaaatttgttttaggttttgctcaatccactgtcgagaaaagctttaaagatgctggactggtagtagaaattgcgccgtttggcggtgaatgttcgcaaaatgagatcgaccgtctgcgtggcatcgcggagactgcgcagtgtggcgcaattctcgatatcggtggcggaaaaaccctcgatactgccaaagcactggcacatttcatgggtgttccggtagcgatcgcaccgactatcgcctctaccgatgcaccgtgcagcgcattgtctgttatctacaccgatgagggtgagtttgaccgctatctgctgttgccaaataacccgaatatggtcattgtcgacaccaaaatcgtcgctggcgcacctgcacgtctgttagcggcgggtatcggcgatgcgctggcaacctggtttgaagcgcgtgcctgctctcgtagcggcgcgaccaccatggcgggcggcaagtgtacccaggctgcgctggcactggctgaactgtgctacaacaccctgctggaagaaggcgaaaaagcgatgcttgctgccgaacagcatgtagtgactccggcgctggagcgcgtgattgaagcgaacacctatttgagcggtgttggttttgaaagtggtggtctggctgcggcgcacgcagtgcataacggcctgaccgctatcccggacgcgcatcactattatcacggtgaaaaagtggcattcggtacgctgacgcagctggttctggaaaatgcgccggtggaggaaatcgaaaccgtagctgcccttagccatgcggtaggtttgccaataactctcgctcaactggatattaaagaagatgtcccggcgaaaatgcgaattgtggcagaagcggcatgtgcagaaggtgaaaccattcacaacatgcctggcggcgcgacgccagatcaggtttacgccgctctgctggtagccgaccagtacggtcagcgtttcctgcaagagtgggaataa

SEQ ID NO: 11696 - protein, 380 aa, Escherichia coli
MPHLALLISKGAIMDRIIQSPGKYIQGADVINRLGEYLKPLAERWLVVGDKFVLGFAQSTVEKSFKDAGLVVEIAPFGGECSQNEIDRLRGIAETAQCGAILDIGGGKTLDTAKALAHFMGVPVAIAPTIASTDAPCSALSVIYTDEGEFDRYLLLPNNPNMVIVDTKIVAGAPARLLAAGIGDALATWFEARACSRSGATTMAGGKCTQAALALAELCYNTLLEEGEKAMLAAEQHVVTPALERVIEANTYLSGVGFESGGLAAAHAVHNGLTAIPDAHHYYHGEKVAFGTLTQLVLENAPVEEIETVAALSHAVGLPITLAQLDIKEDVPAKMRIVAEAACAEGETIHNMPGGATPDQVYAALLVADQYGQRFLQEWE

SEQ ID NO: 11697 - DNA, 1143 bp, Escherichia coli; identical to SEQ ID NO: 172
  CDS (1)..(1143): transl_table=11

SEQ ID NO: 11698 - protein, 380 aa, Escherichia coli; identical to SEQ ID NO: 173

SEQ ID NO: 11699 - DNA, 1080 bp, Synechococcus sp. WH 7803; identical to SEQ ID NO: 174
  CDS (1)..(1080): transl_table=11

SEQ ID NO: 11700 - protein, 359 aa, Synechococcus sp. WH 7803; identical to SEQ ID NO: 175

SEQ ID NO: 11701 - DNA, 1095 bp, Thermotoga maritima MSB8; identical to SEQ ID NO: 176
  CDS (1)..(1095): transl_table=11

SEQ ID NO: 11702 - protein, 364 aa, Thermotoga maritima MSB8; identical to SEQ ID NO: 177

SEQ ID NO: 11703 - DNA, 1077 bp, Lactococcus lactis subsp. lactis Il1403; identical to SEQ ID NO: 178
  CDS (1)..(1077): transl_table=11

SEQ ID NO: 11704 - protein, 358 aa, Lactococcus lactis subsp. lactis Il1403; identical to SEQ ID NO: 179

SEQ ID NO: 11705 - DNA, 1089 bp, Streptococcus pyogenes M1 GAS; identical to SEQ ID NO: 180
  CDS (1)..(1089): transl_table=11

SEQ ID NO: 11706 - protein, 362 aa, Streptococcus pyogenes M1 GAS; identical to SEQ ID NO: 181

SEQ ID NO: 11707 - DNA, 1089 bp, Escherichia coli O157:H7 EDL933; identical to SEQ ID NO: 182
  CDS (1)..(1089): transl_table=11
  misc_feature (1008)..(1008): r is g or a

SEQ ID NO: 11708 - protein, 362 aa, Escherichia coli O157:H7 EDL933; identical to SEQ ID NO: 183

SEQ ID NO: 11709 - DNA, 1143 bp, Escherichia coli O157:H7 EDL933; identical to SEQ ID NO: 184
  CDS (1)..(1143): transl_table=11

SEQ ID NO: 11710 - protein, 380 aa, Escherichia coli O157:H7 EDL933; identical to SEQ ID NO: 185

SEQ ID NO: 11711 - DNA, 1089 bp, Streptococcus pneumoniae TIGR4; identical to SEQ ID NO: 186
  CDS (1)..(1089): transl_table=11

SEQ ID NO: 11712 - protein, 362 aa, Streptococcus pneumoniae TIGR4; identical to SEQ ID NO: 187

SEQ ID NO: 11713 - DNA, 1089 bp, Streptococcus pneumoniae R6; identical to SEQ ID NO: 188
  CDS (1)..(1089): transl_table=11

SEQ ID NO: 11714 - protein, 362 aa, Streptococcus pneumoniae R6; identical to SEQ ID NO: 189

SEQ ID NO: 11715 - DNA, 1095 bp, Sinorhizobium meliloti 1021; identical to SEQ ID NO: 190
  CDS (1)..(1095): transl_table=11

SEQ ID NO: 11716 - protein, 364 aa, Sinorhizobium meliloti 1021; identical to SEQ ID NO: 191

SEQ ID NO: 11717 - DNA, 1098 bp, Halobacterium sp. NRC-1; identical to SEQ ID NO: 192
  CDS (1)..(1098): transl_table=11

SEQ ID NO: 11718 - protein, 365 aa, Halobacterium sp. NRC-1; identical to SEQ ID NO: 193

SEQ ID NO: 11719 - DNA, 1092 bp, Yersinia pestis CO92; identical to SEQ ID NO: 194
  CDS (1)..(1092): transl_table=11

SEQ ID NO: 11720 - protein, 363 aa, Yersinia pestis CO92; identical to SEQ ID NO: 195

SEQ ID NO: 11721 - DNA, 1089 bp, Salmonella typhimurium LT2; identical to SEQ ID NO: 196
  CDS (1)..(1089): transl_table=11

SEQ ID NO: 11722 - protein, 362 aa, Salmonella typhimurium LT2; identical to SEQ ID NO: 197

SEQ ID NO: 11723 - DNA, 1110 bp, Salmonella typhimurium LT2; identical to SEQ ID NO: 198
  CDS (1)..(1110): transl_table=11

SEQ ID NO: 11724 - protein, 369 aa, Salmonella typhimurium LT2; identical to SEQ ID NO: 199

SEQ ID NO: 11725 - DNA, 1104 bp, Salmonella typhimurium LT2; identical to SEQ ID NO: 200
  CDS (1)..(1104): transl_table=11

SEQ ID NO: 11726 - protein, 367 aa, Salmonella typhimurium LT2; identical to SEQ ID NO: 201

SEQ ID NO: 11727 - DNA, 1107 bp, Listeria monocytogenes EGD-e; identical to SEQ ID NO: 202
  CDS (1)..(1107): transl_table=11

SEQ ID NO: 11728 - protein, 368 aa, Listeria monocytogenes EGD-e; identical to SEQ ID NO: 203

SEQ ID NO: 11729 - DNA, 1107 bp, Listeria innocua Clip11262; identical to SEQ ID NO: 204
  CDS (1)..(1107): transl_table=11

SEQ ID NO: 11730 - protein, 368 aa, Listeria innocua Clip11262; identical to SEQ ID NO: 205

SEQ ID NO: 11731 - DNA, 1191 bp, Nostoc sp. PCC 7120; identical to SEQ ID NO: 206
  CDS (1)..(1191): transl_table=11

SEQ ID NO: 11732 - protein, 396 aa, Nostoc sp. PCC 7120; identical to SEQ ID NO: 207

SEQ ID NO: 11733 - DNA, 1131 bp, Clostridium perfringens str. 13; identical to SEQ ID NO: 208
  CDS (1)..(1131): transl_table=11

SEQ ID NO: 11734 - protein, 376 aa, Clostridium perfringens str. 13; identical to SEQ ID NO: 209

SEQ ID NO: 11735 - DNA, 1353 bp, Schizosaccharomyces pombe 972h-; identical to SEQ ID NO: 210
  CDS (1)..(1353)

SEQ ID NO: 11736 - protein, 450 aa, Schizosaccharomyces pombe 972h-; identical to SEQ ID NO: 211

SEQ ID NO: 11737 - DNA, 1089 bp, Streptococcus pyogenes MGAS8232; identical to SEQ ID NO: 212
  CDS (1)..(1089): transl_table=11

SEQ ID NO: 11738 - protein, 362 aa, Streptococcus pyogenes MGAS8232; identical to SEQ ID NO: 213

SEQ ID NO: 11739 - DNA, 1155 bp, Yersinia pestis KIM; identical to SEQ ID NO: 214
  CDS (1)..(1155): transl_table=11

SEQ ID NO: 11740 - protein, 384 aa, Yersinia pestis KIM; identical to SEQ ID NO: 215

SEQ ID NO: 11741 - DNA, 1149 bp, Thermosynechococcus elongatus BP-1; identical to SEQ ID NO: 216
  CDS (1)..(1149): transl_table=11

SEQ ID NO: 11742 - protein, 382 aa, Thermosynechococcus elongatus BP-1; identical to SEQ ID NO: 217

SEQ ID NO: 11743 - DNA, 1110 bp, Oceanobacillus iheyensis HTE831; identical to SEQ ID NO: 218
  CDS (1)..(1110): transl_table=11

SEQ ID NO: 11744 - protein, 369 aa, Oceanobacillus iheyensis HTE831; identical to SEQ ID NO: 219

SEQ ID NO: 11745 - DNA, 1134 bp, Oceanobacillus iheyensis HTE831; identical to SEQ ID NO: 220
  CDS (1)..(1134): transl_table=11

SEQ ID NO: 11746 - protein, 377 aa, Oceanobacillus iheyensis HTE831; identical to SEQ ID NO: 221

SEQ ID NO: 11747 - DNA, 1089 bp, Shigella flexneri 2a str. 301; identical to SEQ ID NO: 222
  CDS (1)..(1089): transl_table=11

SEQ ID NO: 11748 - protein, 362 aa, Shigella flexneri 2a str. 301; identical to SEQ ID NO: 223

SEQ ID NO: 11749 - DNA, 1095 bp, Streptococcus mutans UA159; identical to SEQ ID NO: 224
  CDS (1)..(1095): transl_table=11

SEQ ID NO: 11750 - protein, 364 aa, Streptococcus mutans UA159; identical to SEQ ID NO: 225

SEQ ID NO: 11751 - DNA, 1092 bp, Streptococcus mutans UA159; identical to SEQ ID NO: 226
  CDS (1)..(1092): transl_table=11

SEQ ID NO: 11752 - protein, 363 aa, Streptococcus mutans UA159; identical to SEQ ID NO: 227

SEQ ID NO: 11753 - DNA, 1089 bp, Streptococcus agalactiae NEM316; identical to SEQ ID NO: 228
  CDS (1)..(1089): transl_table=11

SEQ ID NO: 11754 - protein, 362 aa, Streptococcus agalactiae NEM316; identical to SEQ ID NO: 229

SEQ ID NO: 11755 - DNA, 1086 bp, Streptococcus agalactiae NEM316; identical to SEQ ID NO: 230
  CDS (1)..(1086): transl_table=11

SEQ ID NO: 11756 - protein, 361 aa, Streptococcus agalactiae NEM316; identical to SEQ ID NO: 231

SEQ ID NO: 11757 - DNA, 1089 bp, Escherichia coli CFT073; identical to SEQ ID NO: 232
  CDS (1)..(1089): transl_table=11
  misc_feature (370)..(370): r is g or a

SEQ ID NO: 11758 - protein, 362 aa, Escherichia coli CFT073; identical to SEQ ID NO: 233
  misc_feature (124)..(124): The Xaa at location 124 stands for Ala, or Thr.

SEQ ID NO: 11759 - DNA, 1143 bp, Escherichia coli CFT073; identical to SEQ ID NO: 234
  CDS (1)..(1143): transl_table=11

SEQ ID NO: 11760 - protein, 380 aa, Escherichia coli CFT073; identical to SEQ ID NO: 235

SEQ ID NO: 11761 - DNA, 1101 bp, Clostridium tetani E88; identical to SEQ ID NO: 236
  CDS (1)..(1101): transl_table=11

SEQ ID NO: 11762 - protein, 366 aa, Clostridium tetani E88; identical to SEQ ID NO: 237

SEQ ID NO: 11763 - DNA, 1083 bp, Vibrio parahaemolyticus RIMD 2210633; identical to SEQ ID NO: 238
  CDS (1)..(1083): transl_table=11

SEQ ID NO: 11764 - protein, 360 aa, Vibrio parahaemolyticus RIMD 2210633; identical to SEQ ID NO: 239

SEQ ID NO: 11765 - DNA, 1089 bp, Streptococcus pyogenes SSI-1; identical to SEQ ID NO: 240
  CDS (1)..(1089): transl_table=11

SEQ ID NO: 11766 - protein, 362 aa, Streptococcus pyogenes SSI-1; identical to SEQ ID NO: 241

SEQ ID NO: 11767 - DNA, 1089 bp, Salmonella enterica subsp. enterica serovar Typhi Ty2; identical to SEQ ID NO: 242
  CDS (1)..(1089): transl_table=11

SEQ ID NO: 11768 - protein, 362 aa, Salmonella enterica subsp. enterica serovar Typhi Ty2; identical to SEQ ID NO: 243

SEQ ID NO: 11769 - DNA, 1104 bp, Salmonella enterica subsp. enterica serovar Typhi Ty2; identical to SEQ ID NO: 244
  CDS (1)..(1104): transl_table=11

SEQ ID NO: 11770 - protein, 367 aa, Salmonella enterica subsp. enterica serovar Typhi Ty2; identical to SEQ ID NO: 245

SEQ ID NO: 11771 - DNA, 1089 bp, Enterococcus faecalis V583; identical to SEQ ID NO: 246
  CDS (1)..(1089): transl_table=11

SEQ ID NO: 11772 - protein, 362 aa, Enterococcus faecalis V583; identical to SEQ ID NO: 247

SEQ ID NO: 11773 - DNA, 1140 bp, Enterococcus faecalis V583; identical to SEQ ID NO: 248
  CDS (1)..(1140): transl_table=11

SEQ ID NO: 11774 - protein, 379 aa, Enterococcus faecalis V583; identical to SEQ ID NO: 249

SEQ ID NO: 11775 - DNA, 1134 bp, Prochlorococcus marinus subsp. marinus str. CCMP1375; identical to SEQ ID NO: 250
  CDS (1)..(1134): transl_table=11

SEQ ID NO: 11776 - protein, 377 aa, Prochlorococcus marinus subsp. marinus str. CCMP1375; identical to SEQ ID NO: 251

SEQ ID NO: 11777 - DNA, 1095 bp, Prochlorococcus marinus subsp. pastoris str. CCMP1986; identical to SEQ ID NO: 252
  CDS (1)..(1095): transl_table=11

SEQ ID NO: 11778 - protein, 364 aa, Prochlorococcus marinus subsp. pastoris str. CCMP1986; identical to SEQ ID NO: 253

SEQ ID NO: 11779 - DNA, 1161 bp, Prochlorococcus marinus str. MIT 9313; identical to SEQ ID NO: 254
  CDS (1)..(1161): transl_table=11

SEQ ID NO: 11780 - protein, 386 aa, Prochlorococcus marinus str. MIT 9313; identical to SEQ ID NO: 255

SEQ ID NO: 11781 - DNA, 1101 bp, Synechococcus sp. WH 8102; identical to SEQ ID NO: 256
  CDS (1)..(1101): transl_table=11

SEQ ID NO: 11782 - protein, 366 aa, Synechococcus sp. WH 8102; identical to SEQ ID NO: 257

SEQ ID NO: 11783 - DNA, 1077 bp, Gloeobacter violaceus PCC 7421; identical to SEQ ID NO: 258
  CDS (1)..(1077): transl_table=11

SEQ ID NO: 11784 - protein, 358 aa, Gloeobacter violaceus PCC 7421; identical to SEQ ID NO: 259

SEQ ID NO: 11785 - DNA, 1101 bp, Photorhabdus luminescens subsp. laumondii TTO1; identical to SEQ ID NO: 260
  CDS (1)..(1101): transl_table=11

SEQ ID NO: 11786 - protein, 366 aa, Photorhabdus luminescens subsp. laumondii TTO1; identical to SEQ ID NO: 261

SEQ ID NO: 11787 - DNA, 1089 bp, Vibrio vulnificus YJ016; identical to SEQ ID NO: 262
  CDS (1)..(1089): transl_table=11

SEQ ID NO: 11788 - protein, 362 aa, Vibrio vulnificus YJ016; identical to SEQ ID NO: 263

SEQ ID NO: 11789 - DNA, 1092 bp, Prochlorococcus marinus str. AS9601; identical to SEQ ID NO: 264
  CDS (1)..(1092): transl_table=11

SEQ ID NO: 11790 - protein, 363 aa, Prochlorococcus marinus str. AS9601; identical to SEQ ID NO: 265

SEQ ID NO: 11791 - DNA, 1095 bp, Prochlorococcus marinus str. MIT 9515; identical to SEQ ID NO: 266
  CDS (1)..(1095): transl_table=11

SEQ ID NO: 11792 - protein, 364 aa, Prochlorococcus marinus str. MIT 9515; identical to SEQ ID NO: 267

SEQ ID NO: 11793 - DNA, 1119 bp, Prochlorococcus marinus str. NATL1A; identical to SEQ ID NO: 268
  CDS (1)..(1119): transl_table=11

SEQ ID NO: 11794 - protein, 372 aa, Prochlorococcus marinus str. NATL1A; identical to SEQ ID NO: 269

SEQ ID NO: 11795 - DNA, 1254 bp, Prochlorococcus marinus str. MIT 9303; identical to SEQ ID NO: 270
  CDS (1)..(1254): transl_table=11

SEQ ID NO: 11796 - protein, 417 aa, Prochlorococcus marinus str. MIT 9303; identical to SEQ ID NO: 271

SEQ ID NO: 11797 - DNA, 1092 bp, Prochlorococcus marinus str. MIT 9301; identical to SEQ ID NO: 272
  CDS (1)..(1092): transl_table=11

SEQ ID NO: 11798 - protein, 363 aa, Prochlorococcus marinus str. MIT 9301; identical to SEQ ID NO: 273

SEQ ID NO: 11799 - DNA, 1104 bp, Listeria monocytogenes str. 4b F2365; identical to SEQ ID NO: 274
  CDS (1)..(1104): transl_table=11

SEQ ID NO: 11800 - protein, 367 aa, Listeria monocytogenes str. 4b F2365; identical to SEQ ID NO: 275

SEQ ID NO: 11801 - DNA, 1098 bp, Erwinia carotovora subsp. atroseptica SCRI1043; identical to SEQ ID NO: 276
  CDS (1)..(1098): transl_table=11

SEQ ID NO: 11802 - protein, 365 aa, Erwinia carotovora subsp. atroseptica SCRI1043; identical to SEQ ID NO: 277

SEQ ID NO: 11803 - DNA, 1104 bp, Erwinia carotovora subsp. atroseptica SCRI1043; identical to SEQ ID NO: 278
  CDS (1)..(1104): transl_table=11

SEQ ID NO: 11804 - protein, 367 aa, Erwinia carotovora subsp. atroseptica SCRI1043; identical to SEQ ID NO: 279

SEQ ID NO: 11805 - DNA, 1089 bp, Erwinia carotovora subsp. atroseptica SCRI1043; identical to SEQ ID NO: 280
  CDS (1)..(1089): transl_table=11

SEQ ID NO: 11806 - protein, 362 aa, Erwinia carotovora subsp. atroseptica SCRI1043; identical to SEQ ID NO: 281

SEQ ID NO: 11807 - DNA, 1101 bp, Symbiobacterium thermophilum IAM 14863; identical to SEQ ID NO: 282
  CDS (1)..(1101): transl_table=11

SEQ ID NO: 11808 - protein, 366 aa, Symbiobacterium thermophilum IAM 14863; identical to SEQ ID NO: 283

SEQ ID NO: 11809 - DNA, 1056 bp, Bacillus licheniformis ATCC 14580; identical to SEQ ID NO: 284
  CDS (1)..(1056): transl_table=11

SEQ ID NO: 11810 - protein, 351 aa, Bacillus licheniformis ATCC 14580; identical to SEQ ID NO: 285

SEQ ID NO: 11811 - DNA, 1104 bp, Bacillus licheniformis ATCC 14580; identical to SEQ ID NO: 286
  CDS (1)..(1104): transl_table=11

SEQ ID NO: 11812 - protein, 367 aa, Bacillus licheniformis ATCC 14580; identical to SEQ ID NO: 287

SEQ ID NO: 11813 - DNA, 1197 bp, Synechococcus elongatus PCC 6301; identical to SEQ ID NO: 288
  CDS (1)..(1197): transl_table=11

SEQ ID NO: 11814 - protein, 398 aa, Synechococcus elongatus PCC 6301; identical to SEQ ID NO: 289

SEQ ID NO: 11815 - DNA, 1107 bp, Bacillus clausii KSM-K16; identical to SEQ ID NO: 290
  CDS (1)..(1107): transl_table=11

SEQ ID NO: 11816 - protein, 368 aa, Bacillus clausii KSM-K16; identical to SEQ ID NO: 291

SEQ ID NO: 11817 - DNA, 1095 bp, Bacillus clausii KSM-K16; identical to SEQ ID NO: 292
  CDS (1)..(1095): transl_table=11

SEQ ID NO: 11818 - protein, 364 aa, Bacillus clausii KSM-K16; identical to SEQ ID NO: 293

SEQ ID NO: 11819 - DNA, 1104 bp, Staphylococcus epidermidis RP62A; identical to SEQ ID NO: 294
  CDS (1)..(1104): transl_table=11

SEQ ID NO: 11820 - protein, 367 aa, Staphylococcus epidermidis RP62A; identical to SEQ ID NO: 295

SEQ ID NO: 11821 - DNA, 1188 bp, Thermobifida fusca YX; identical to SEQ ID NO: 296
  CDS (1)..(1188): transl_table=11

SEQ ID NO: 11822 - protein, 395 aa, Thermobifida fusca YX; identical to SEQ ID NO: 297

SEQ ID NO: 11823 - DNA, 1119 bp, Prochlorococcus marinus str. NATL2A; identical to SEQ ID NO: 298
  CDS (1)..(1119): transl_table=11

SEQ ID NO: 11824 - protein, 372 aa, Prochlorococcus marinus str. NATL2A; identical to SEQ ID NO: 299

SEQ ID NO: 11825 - DNA, 1098 bp, Ralstonia eutropha JMP134; identical to SEQ ID NO: 300
  CDS (1)..(1098): transl_table=11

SEQ ID NO: 11826 - protein, 365 aa, Ralstonia eutropha JMP134; identical to SEQ ID NO: 301

SEQ ID NO: 11827 - DNA, 1191 bp, Anabaena variabilis ATCC 29413; identical to SEQ ID NO: 302
  CDS (1)..(1191): transl_table=11

SEQ ID NO: 11828 - protein, 396 aa, Anabaena variabilis ATCC 29413; identical to SEQ ID NO: 303

SEQ ID NO: 11829 - DNA, 1101 bp, Synechococcus sp. CC9605; identical to SEQ ID NO: 304
  CDS (1)..(1101): transl_table=11

SEQ ID NO: 11830 - protein, 366 aa, Synechococcus sp. CC9605; identical to SEQ ID NO: 305

SEQ ID NO: 11831 - DNA, 1092 bp, Prochlorococcus marinus str. MIT 9312; identical to SEQ ID NO: 306
  CDS (1)..(1092): transl_table=11

SEQ ID NO: 11832 - protein, 363 aa, Prochlorococcus marinus str. MIT 9312; identical to SEQ ID NO: 307

SEQ ID NO: 11833 - DNA, 1197 bp, Synechococcus elongatus PCC 7942; identical to SEQ ID NO: 308
  CDS (1)..(1197): transl_table=11

SEQ ID NO: 11834 - protein, 398 aa, Synechococcus elongatus PCC 7942; identical to SEQ ID NO: 309

SEQ ID NO: 11835 - DNA, 1080 bp, Synechococcus elongatus PCC 7942; identical to SEQ ID NO: 310
  CDS (1)..(1080): transl_table=11

SEQ ID NO: 11836 - protein, 359 aa, Synechococcus elongatus PCC 7942; identical to SEQ ID NO: 311

SEQ ID NO: 11837 - DNA, 1092 bp, Moorella thermoacetica ATCC 39073; identical to SEQ ID NO: 312
  CDS (1)..(1092): transl_table=11

SEQ ID NO: 11838 - protein, 363 aa, Moorella thermoacetica ATCC 39073; identical to SEQ ID NO: 313

SEQ ID NO: 11839 - DNA, 1074 bp, Methanococcoides burtonii DSM 6242; identical to SEQ ID NO: 314
  CDS (1)..(1074): transl_table=11

SEQ ID NO: 11840 - protein, 357 aa, Methanococcoides burtonii DSM 6242; identical to SEQ ID NO: 315

SEQ ID NO: 11841 - DNA, 1131 bp, Clostridium perfringens ATCC 13124; identical to SEQ ID NO: 316
  CDS (1)..(1131): transl_table=11

SEQ ID NO: 11842 - protein, 376 aa, Clostridium perfringens ATCC 13124; identical to SEQ ID NO: 317

SEQ ID NO: 11843 - DNA, 1134 bp, Trichodesmium erythraeum IMS101; identical to SEQ ID NO: 318
  CDS (1)..(1134): transl_table=11

SEQ ID NO: 11844 - protein, 377 aa, Trichodesmium erythraeum IMS101; identical to SEQ ID NO: 319

SEQ ID NO: 11845 - DNA, 1137 bp, Synechococcus sp. CC9311; identical to SEQ ID NO: 320
  CDS (1)..(1137): transl_table=11

SEQ ID NO: 11846 - protein, 378 aa, Synechococcus sp. CC9311; identical to SEQ ID NO: 321

SEQ ID NO: 11847 - DNA, 1122 bp, Synechococcus sp. CC9311; identical to SEQ ID NO: 322
  CDS (1)..(1122): transl_table=11

SEQ ID NO: 11848 - protein, 373 aa, Synechococcus sp. CC9311; identical to SEQ ID NO: 323

SEQ ID NO: 11849 - DNA, 1191 bp, Nostoc punctiforme PCC 73102; identical to SEQ ID NO: 324
  CDS (1)..(1191): transl_table=11

SEQ ID NO: 11850 - protein, 396 aa, Nostoc punctiforme PCC 73102; identical to SEQ ID NO: 325

SEQ ID NO: 11851 - DNA, 1107 bp, Listeria monocytogenes str. 4b H7858; identical to SEQ ID NO: 326
  CDS (1)..(1107): transl_table=11

SEQ ID NO: 11852 - protein, 368 aa, Listeria monocytogenes str. 4b H7858; identical to SEQ ID NO: 327

SEQ ID NO: 11853 - DNA, 1107 bp, Listeria monocytogenes str. 1/2a F6854; identical to SEQ ID NO: 328
  CDS (1)..(1107): transl_table=11

SEQ ID NO: 11854 - protein, 368 aa, Listeria monocytogenes str. 1/2a F6854; identical to SEQ ID NO: 329

SEQ ID NO: 11855 - DNA, 1122 bp, Crocosphaera watsonii WH 8501; identical to SEQ ID NO: 330
  CDS (1)..(1122): transl_table=11

SEQ ID NO: 11856 - protein, 373 aa, Crocosphaera watsonii WH 8501; identical to SEQ ID NO: 331

SEQ ID NO: 11857 - DNA, 1026 bp, Exiguobacterium sibiricum 255-15; identical to SEQ ID NO: 332
  CDS (1)..(1026): transl_table=11

SEQ ID NO: 11858 - protein, 341 aa, Exiguobacterium sibiricum 255-15; identical to SEQ ID NO: 333

SEQ ID NO: 11859 - DNA, 1110 bp, Exiguobacterium sibiricum 255-15; identical to SEQ ID NO: 334
  CDS (1)..(1110): transl_table=11

SEQ ID NO: 11860 - protein, 369 aa, Exiguobacterium sibiricum 255-15; identical to SEQ ID NO: 335

SEQ ID NO: 11861 - DNA, 1146 bp, Synechococcus sp. RS9917; identical to SEQ ID NO: 336
  CDS (1)..(1146): transl_table=11

SEQ ID NO: 11862 - protein, 381 aa, Synechococcus sp. RS9917; identical to SEQ ID NO: 337

SEQ ID NO: 11863 - DNA, 1188 bp, Synechococcus sp. WH 5701; identical to SEQ ID NO: 338
  CDS (1)..(1188): transl_table=11

SEQ ID NO: 11864 - protein, 395 aa, Synechococcus sp. WH 5701; identical to SEQ ID NO: 339

SEQ ID NO: 11865 - DNA, 1122 bp, Synechococcus sp. WH 7805; identical to SEQ ID NO: 340
  CDS (1)..(1122): transl_table=11

SEQ ID NO: 11866 - protein, 373 aa, Synechococcus sp. WH 7805; identical to SEQ ID NO: 341

SEQ ID NO: 11867 - DNA, 1098 bp, Photobacterium sp. SKA34; identical to SEQ ID NO: 342
  CDS (1)..(1098): transl_table=11

SEQ ID NO: 11868 - protein, 365 aa, Photobacterium sp. SKA34; identical to SEQ ID NO: 343

SEQ ID NO: 11869 - DNA, 1089 bp, Xanthobacter autotrophicus Py2; identical to SEQ ID NO: 344
  CDS (1)..(1089): transl_table=11

SEQ ID NO: 11870 - protein, 362 aa, Xanthobacter autotrophicus Py2; identical to SEQ ID NO: 345

SEQ ID NO: 11871 - DNA, 1146 bp, Xanthobacter autotrophicus Py2; identical to SEQ ID NO: 346
  CDS (1)..(1146): transl_table=11

SEQ ID NO: 11872 - protein, 381 aa, Xanthobacter autotrophicus Py2; identical to SEQ ID NO: 347

SEQ ID NO: 11873 - DNA, 1056 bp, Synechococcus sp. RS9916; identical to SEQ ID NO: 348
  CDS (1)..(1056): transl_table=11

SEQ ID NO: 11874 - protein, 351 aa, Synechococcus sp. RS9916; identical to SEQ ID NO: 349

SEQ ID NO: 11875 - DNA, 1083 bp, Vibrio sp. Ex25; identical to SEQ ID NO: 350
  CDS (1)..(1083): transl_table=11

SEQ ID NO: 11876 - protein, 360 aa, Vibrio sp. Ex25; identical to SEQ ID NO: 351

SEQ ID NO: 11877 - DNA, 1098 bp, Klebsiella pneumoniae; identical to SEQ ID NO: 352
  CDS (1)..(1098): transl_table=11

SEQ ID NO: 11878 - protein, 365 aa, Klebsiella pneumoniae; identical to SEQ ID NO: 353

SEQ ID NO: 11879 - DNA, 1098 bp, Escherichia blattae; identical to SEQ ID NO: 354
  CDS (1)..(1098): transl_table=11

SEQ ID NO: 11880 - protein, 365 aa, Escherichia blattae; identical to SEQ ID NO: 355

SEQ ID NO: 11881 - DNA, 1083 bp, Escherichia coli; identical to SEQ ID NO: 356
  CDS (1)..(1083): transl_table=11

SEQ ID NO: 11882 - protein, 360 aa, Escherichia coli; identical to SEQ ID NO: 357

SEQ ID NO: 11883 - DNA, 1143 bp, Clostridium butyricum; identical to SEQ ID NO: 358
  CDS (1)..(1143): transl_table=11

SEQ ID NO: 11884 - protein, 380 aa, Clostridium butyricum; identical to SEQ ID NO: 359

SEQ ID NO: 11885 - DNA, 1059 bp, Clostridium beijerinckii; identical to SEQ ID NO: 360
  CDS (1)..(1059): transl_table=11

SEQ ID NO: 11886 - protein, 352 aa, Clostridium beijerinckii; identical to SEQ ID NO: 361

SEQ ID NO: 11887 - DNA, 1113 bp, Bacillus stearothermophilus; identical to SEQ ID NO: 362
  CDS (1)..(1113): transl_table=11

SEQ ID NO: 11888 - protein, 370 aa, Bacillus stearothermophilus; identical to SEQ ID NO: 363

SEQ ID NO: 11889 - DNA, 1098 bp, Citrobacter freundii; identical to SEQ ID NO: 364
  CDS (1)..(1098): transl_table=11

SEQ ID NO: 11890 - protein, 365 aa, Citrobacter freundii; identical to SEQ ID NO: 365

SEQ ID NO: 11891 - DNA, 1143 bp, Escherichia coli O6; identical to SEQ ID NO: 172
  CDS (40)..(1143): transl_table=11

SEQ ID NO: 11892 - protein, 367 aa, Escherichia coli O6; identical to SEQ ID NO: 367

SEQ ID NO: 11893 - DNA, 1098 bp, Pseudomonas putida; identical to SEQ ID NO: 368
  CDS (1)..(1098): transl_table=11

SEQ ID NO: 11894 - protein, 365 aa, Pseudomonas putida; identical to SEQ ID NO: 369

SEQ ID NO: 11895 - DNA, 1158 bp, Synechocystis sp; identical to SEQ ID NO: 370
  CDS (1)..(1158): transl_table=11

SEQ ID NO: 11896 - protein, 385 aa, Synechocystis sp; identical to SEQ ID NO: 371

SEQ ID NO: 11897 - DNA, 1089 bp, Escherichia coli; identical to SEQ ID NO: 372
  CDS (1)..(1089): transl_table=11

SEQ ID NO: 11898 - protein, 362 aa, Escherichia coli; identical to SEQ ID NO: 373

SEQ ID NO: 11899 - DNA, 23 bp, Artificial sequence
  primer
atgccgcatttggcactactcat

SEQ ID NO: 11900 - DNA, 23 bp, Artificial sequence
  primer
ttattcccactcttgcaggaaac

SEQ ID NO: 11901 - protein, 375 aa, Artificial sequence; identical to SEQ ID NO: 376
  consensus sequence
  Variant (2)..(72): Xaa in position 2 to 72 is any amino acid
  Variant (73)..(86): Xaa in position 73 to 86 is any or no amino acid
  Variant (91)..(92): Xaa in position 91 to 92 is any amino acid
  Variant (94)..(95): Xaa in position 94 to 95 is any amino acid
  Variant (97)..(98): Xaa in position 97 to 98 is any amino acid
  Variant (100)..(107): Xaa in position 100 to 107 is any amino acid
  Variant (108)..(110): Xaa in position 108 to 110 is any or no amino acid
  Variant (113)..(113): Xaa in position 113 is any amino acid
  Variant (115)..(115): Xaa in position 115 is any amino acid
  Variant (117)..(117): Xaa in position 117 is any amino acid
  Variant (119)..(122): Xaa in position 119 to 122 is any amino acid
  Variant (124)..(126): Xaa in position 124 to 126 is any amino acid
  Variant (128)..(130): Xaa in position 128 to 130 is any amino acid
  Variant (132)..(140): Xaa in position 132 to 140 is any amino acid
  Variant (141)..(142): Xaa in position 141 to 142 is any or no amino acid
  Variant (144)..(148): Xaa in position 144 to 148 is any amino acid
  Variant (150)..(155): Xaa in position 150 to 155 is any amino acid
  Variant (158)..(160): Xaa in position 158 to 160 is any amino acid
  Variant (162)..(163): Xaa in position 162 to 163 is any amino acid
  Variant (165)..(166): Xaa in position 165 to 166 is any amino acid
  Variant (168)..(168): Xaa in position 168 is any amino acid
  Variant (171)..(173): Xaa in position 171 to 173 is any amino acid
  Variant (176)..(193): Xaa in position 176 to 193 is any amino acid
  Variant (194)..(210): Xaa in position 194 to 210 is any or no amino acid
  Variant (212)..(217): Xaa in position 212 to 217 is any amino acid
  Variant (219)..(224): Xaa in position 219 to 224 is any amino acid
  Variant (226)..(239): Xaa in position 226 to 239 is any amino acid
  Variant (240)..(243): Xaa in position 240 to 243 is any or no amino acid
  Variant (245)..(249): Xaa in position 245 to 249 is any amino acid
  Variant (250)..(253): Xaa in position 250 to 253 is any or no amino acid
  Variant (255)..(255): Xaa in position 255 is any amino acid
  Variant (257)..(264): Xaa in position 257 to 264 is any amino acid
  Variant (265)..(267): Xaa in position 265 to 267 is any or no amino acid
  Variant (271)..(271): Xaa in position 271 is any amino acid
  Variant (275)..(275): Xaa in position 275 is any amino acid
  Variant (277)..(284): Xaa in position 277 to 284 is any amino acid
  Variant (285)..(286): Xaa in position 285 to 286 is any or no amino acid
  Variant (289)..(289): Xaa in position 289 is any amino acid
  Variant (292)..(293): Xaa in position 292 to 293 is any amino acid
  Variant (295)..(295): Xaa in position 295 is any amino acid
  Variant (297)..(297): Xaa in position 297 is any amino acid
  Variant (300)..(300): Xaa in position 300 is any amino acid
  Variant (303)..(317): Xaa in position 303 to 317 is any amino acid
  Variant (318)..(326): Xaa in position 318 to 326 is any or no amino acid
  Variant (329)..(330): Xaa in position 329 to 330 is any amino acid
  Variant (332)..(356): Xaa in position 332 to 356 is any amino acid
  Variant (357)..(363): Xaa in position 357 to 363 is any or no amino acid
  Variant (365)..(373): Xaa in position 365 to 373 is any amino acid
  Variant (374)..(374): Xaa in position 374 is any or no amino acid

SEQ ID NO: 11902 - protein, 21 aa, Artificial sequence
  protein pattern
  Variant (2)..(3): Xaa in position 2 to 3 is any amino acid
  Variant (4)..(4): Xaa in position 4 is Ala or Gly
  Variant (5)..(5): Xaa in position 5 is Ala or Ser
  Variant (7)..(7): Xaa in position 7 is Cys, Asp or Asn
  Variant (9)..(9): Xaa in position 9 is Ala, Gly or Pro
  Variant (10)..(10): Xaa in position 10 is any amino acid
  Variant (11)..(11): Xaa in position 11 is Ala, Ser or Thr
  Variant (12)..(13): Xaa in position 12 to 13 is any amino acid
  Variant (14)..(14): Xaa in position 14 is Ala, Ser or Val
  Variant (15)..(16): Xaa in position 15 to 16 is any amino acid
  Variant (18)..(20): Xaa in position 18 to 20 is any amino acid
PXXXXTXAXXXXXXXXYXXXG

SEQ ID NO: 11903 - protein, 24 aa, Artificial sequence
  protein pattern
  Variant (2)..(6): Xaa in position 2 to 6 is any or no amino acid
  Variant (8)..(8): Xaa in position 8 is any amino acid
  Variant (9)..(9): Xaa in position 9 is Asp, Glu, Gln or Arg
  Variant (10)..(10): Xaa in position 10 is any amino acid
  Variant (11)..(11): Xaa in position 11 is Phe or Leu
  Variant (12)..(12): Xaa in position 12 is any amino acid
  Variant (13)..(13): Xaa in position 13 is Ala or Ser
  Variant (15)..(15): Xaa in position 15 is Ile, Leu, Met or Val
  Variant (16)..(16): Xaa in position 16 is Ala, Gly, Ser or Val
  Variant (18)..(18): Xaa in position 18 is Ala, Gly, Ser or Thr
  Variant (19)..(19): Xaa in position 19 is Ile, Leu, Met or Val
  Variant (20)..(20): Xaa in position 20 is Ala or Ser
  Variant (21)..(23): Xaa in position 21 to 23 is any amino acid
AXXXXXPXXXXXXGXXDXXXXXXE

SEQ ID NO: 11904 - protein, 21 aa, Artificial sequence
  protein pattern
  Variant (2)..(2): Xaa in position 2 is any amino acid
  Variant (3)..(3): Xaa in position 3 is Asp, Glu, Asn, Gln, Arg or Ser
  Variant (4)..(7): Xaa in position 4 to 7 is any amino acid
  Variant (9)..(9): Xaa in position 9 is any or no amino acid
  Variant (11)..(11): Xaa in position 11 is any or no amino acid
  Variant (13)..(13): Xaa in position 13 is Ala, Pro or Ser
  Variant (14)..(14): Xaa in position 14 is Phe, Ile or Val
  Variant (16)..(16): Xaa in position 16 is Asp or Asn
  Variant (17)..(17): Xaa in position 17 is Ala or Gly
  Variant (18)..(18): Xaa in position 18 is Phe, Ile, Leu or Met
  Variant (19)..(19): Xaa in position 19 is Ser or Thr
  Variant (20)..(20): Xaa in position 20 is any amino acid
  Variant (21)..(21): Xaa in position 21 is Ile, Leu or Val
GXXXXXXAXAXHXXHXXXXXX

SEQ ID NO: 11905 - protein, 15 aa, Artificial sequence
  protein pattern
  Variant (3)..(3): Xaa in position 3 is Glu, Asn, Gln, Ser or Thr
  Variant (4)..(4): Xaa in position 4 is any amino acid
  Variant (6)..(6): Xaa in position 6 is Ala, Gly, Ser or Thr
  Variant (7)..(7): Xaa in position 7 is any amino acid
  Variant (9)..(9): Xaa in position 9 is any amino acid
  Variant (11)..(11): Xaa in position 11 is any amino acid
  Variant (13)..(14): Xaa in position 13 to 14 is any or no amino acid
HGXXVXXGXLXQXXL

SEQ ID NO: 11906 - protein, 19 aa, Artificial sequence
  protein pattern
  Variant (5)..(6): Xaa in position 5 to 6 is any amino acid
  Variant (8)..(9): Xaa in position 8 to 9 is any amino acid
  Variant (11)..(18): Xaa in position 11 to 18 is any or no amino acid
GGGKXXDXXKXXXXXXXXA

SEQ ID NO: 11907 - DNA, 2391 bp, Saccharomyces cerevisiae
  CDS (1)..(2391)
atggtttgctgcttatgggtgcttctagcattgttgcttcatctcgatcatgtagcatgcgaagacgatgcgtactcattcacttctaaagaacttaaggcctacaagcaggaagtgaaggagctgttttatttcggcttcgacaattatttagagcatgggtatccatatgatgaggtaaaacccatttcatgcgttcctaagaagagaaactttgaagatcctactgatcaaggcaccaacgatatattgggcaattttacaatcactttaatagattctttaaccactattgctatactggaagaccggccgcagtttttgaaagctgttcgacttgttgaaaggacatttcctgatggcaatttcgatattgattccacaatacaagtttttgaaattactatacgtgttatcggatcactactatcatcacatctttatgctacggatcccacaaaggcagtgtatttaggggacgattatgatggctcactgttacgtctcgcccagaatatggcagataggctcttacctgcatatttaacgtctaccggattacctatgccacggagaaacatcaaacgaaaatgggatgtctctgaatttccagaatttttggagacagagaataatgtggccgctatggcgtctcccatgttcgaattcactattttatcttacttgacaggcgatcccaagtatgagaaagttaccagatacgcatttgataaaacatggtctcttagaactggtttggatttgctacccatgtcctttcaccccgaaaaactaacaccatatacgcccatgactggaatcggcgcctccatcgactcccttttcgaatacgctttgaaaggtgctattttatttgatgattcagaattaatggaagtttggaacgtagcatacgaggcattaaagactaactgtaaaaacgattggttttttgctaatgtaatggctgacacagggcatttgtttgttccctggattgattctttgagtgcttttttctccggtttacaggtgcttgctggtgatttggatgatgccatagcgaaccatttaatgtttttaaaaatgtggaacacctttggcggtattcctgaaaggtggaactttagtcctccggagtttcccccactatctccattagagcgatcgggagctgttgctttggataatatcctccccttagaatggtacccattaagaccggaattttttgagtcaacctatttcttatatagagctacaaaagacccgttttacttaaatattggggtacatctgctaaaagacctcaagcaacgatttaagtctaactgcggatttgcaggtttccaaaatgtaatcacgggcgaactgcaagatagaatggaaacatttgtgttgagtgaaactttgaaatacctgtatttattatttgatgaagagaacgaattacataacagcgctagtgacgtaattttcagtacagaagcccatccaatgtggttgccccaagaagtgaggtccaactataaacgtaacgctaaatttaacaactctgtctactcgtcgcacttggaaatttgccagaaaaaggacagggaacaagctggagagaacacattgagccaaagaattgtggggttcgccaaatcgatctttcataaaggtccaccagacgaagaggctactgatccaattatagactataccattgatactgaacttcccggtacatgctctataaagcctcatcatgtaattggtgacgaattttggtattctccaatgttgagcaattttgacagattattcgagattgactcccggttcgctgccacgctaattaaaccttcacacatgcataactataatgcaattgaactagaacctggattttataacaggtggtccaatccgcaatttagcacgtgcctgatcccacccaccaccgaaattttcgaactactattcgaccttcctggatatcatcagttgaatccattaatgttagaaaacaaaactattacatttgaaacctttggaggtaggtcaaggttgaagatcgaaaaattgcaaatctaccaaattgattactatggagacttaatcactgcatcgacattccaagacgtctcccgcaaggatattttctcgaatgcatgcgatgcagtggcaagcttgtattctcccacttatctttacagagtagtagccatcaacggacgcatattgcctcgccatggaagtgtacaaatcaagaaacatagtcctgtgctcacttccaatggcacaagagaggaagacgaattcaaaatggatggcatcgggattaatgaccattcccaactcatgttagaatgcacgcccatcatcaacttatttattgtatga

SEQ ID NO: 11908 - protein, 796 aa, Saccharomyces cerevisiae; identical to SEQ ID NO: 918

SEQ ID NO: 11909 - DNA, 2055 bp, Oryza sativa (japonica cultivar-group); identical to SEQ ID NO: 919
  CDS (1)..(2055)

SEQ ID NO: 11910 - protein, 684 aa, Oryza sativa (japonica cultivar-group); identical to SEQ ID NO: 920

SEQ ID NO: 11911 - DNA, 1758 bp, Oryza sativa (japonica cultivar-group); identical to SEQ ID NO: 921
  CDS (1)..(1758)

SEQ ID NO: 11912 - protein, 585 aa, Oryza sativa (japonica cultivar-group); identical to SEQ ID NO: 922

SEQ ID NO: 11913 - DNA, 1875 bp, Arabidopsis thaliana; identical to SEQ ID NO: 923
  CDS (1)..(1875)

SEQ ID NO: 11914 - protein, 624 aa, Arabidopsis thaliana; identical to SEQ ID NO: 924

SEQ ID NO: 11915 - DNA, 1725 bp, Arabidopsis thaliana; identical to SEQ ID NO: 925
  CDS (1)..(1725)

SEQ ID NO: 11916 - protein, 574 aa, Arabidopsis thaliana; identical to SEQ ID NO: 926

SEQ ID NO: 11917 - DNA, 2430 bp, Candida glabrata CBS 138; identical to SEQ ID NO: 927
  CDS (1)..(2430)

SEQ ID NO: 11918 - protein, 809 aa, Candida glabrata CBS 138; identical to SEQ ID NO: 928

SEQ ID NO: 11919 - DNA, 2295 bp, Kluyveromyces lactis NRRL Y-1140; identical to SEQ ID NO: 929
  CDS (1)..(2295)

SEQ ID NO: 11920 - protein, 764 aa, Kluyveromyces lactis NRRL Y-1140; identical to SEQ ID NO: 930

SEQ ID NO: 11921 - DNA, 2541 bp, Debaryomyces hansenii CBS767; identical to SEQ ID NO: 931
  CDS (1)..(2541)

SEQ ID NO: 11922 - protein, 846 aa, Debaryomyces hansenii CBS767; identical to SEQ ID NO: 932

SEQ ID NO: 11923 - DNA, 2529 bp, Candida albicans SC5314; identical to SEQ ID NO: 933
  CDS (1)..(2529): transl_table=12

SEQ ID NO: 11924 - protein, 842 aa, Candida albicans SC5314; identical to SEQ ID NO: 934

SEQ ID NO: 11925 - DNA, 1713 bp, Medicago truncatula; identical to SEQ ID NO: 935
  CDS (1)..(1713)

SEQ ID NO: 11926 - protein, 570 aa, Medicago truncatula; identical to SEQ ID NO: 936

SEQ ID NO: 11927 - DNA, 2925 bp, Aspergillus oryzae; identical to SEQ ID NO: 937
  CDS (1)..(2925)

SEQ ID NO: 11928 - protein, 974 aa, Aspergillus oryzae; identical to SEQ ID NO: 938

SEQ ID NO: 11929 - DNA, 2485 bp, Oryza sativa subsp; identical to SEQ ID NO: 939
  CDS (54)..(2084)

SEQ ID NO: 11930 - protein, 676 aa, Oryza sativa subsp; identical to SEQ ID NO: 940

SEQ ID NO: 11931 - DNA, 2391 bp, Saccharomyces cerevisiae; identical to SEQ ID NO: 917
  CDS (1)..(2391)

SEQ ID NO: 11932 - protein, 796 aa, Saccharomyces cerevisiae; identical to SEQ ID NO: 918

SEQ ID NO: 11933 - DNA, 24 bp, Artificial sequence
  primer
atggtttgctgcttatgggtgctt

SEQ ID NO: 11934 - DNA, 27 bp, Artificial sequence
  primer
tcatacaataaataagttgatgatggg

SEQ ID NO: 11935 - protein, 585 aa, Artificial sequence; identical to SEQ ID NO: 943
  consensus sequence
  Variant (2)..(2): Xaa in position 2 is any amino acid
  Variant (4)..(7): Xaa in position 4 to 7 is any amino acid
  Variant (9)..(12): Xaa in position 9 to 12 is any amino acid
  Variant (15)..(15): Xaa in position 15 is any amino acid
  Variant (18)..(19): Xaa in position 18 to 19 is any amino acid
  Variant (21)..(34): Xaa in position 21 to 34 is any amino acid
  Variant (35)..(49): Xaa in position 35 to 49 is any or no amino acid
  Variant (52)..(53): Xaa in position 52 to 53 is any amino acid
  Variant (56)..(57): Xaa in position 56 to 57 is any amino acid
  Variant (59)..(79): Xaa in position 59 to 79 is any amino acid
  Variant (80)..(102): Xaa in position 80 to 102 is any or no amino acid
  Variant (104)..(111): Xaa in position 104 to 111 is any amino acid
  Variant (114)..(115): Xaa in position 114 to 115 is any amino acid
  Variant (118)..(118): Xaa in position 118 is any amino acid
  Variant (123)..(123): Xaa in position 123 is any amino acid
  Variant (125)..(125): Xaa in position 125 is any amino acid
  Variant (128)..(130): Xaa in position 128 to 130 is any amino acid
  Variant (132)..(140): Xaa in position 132 to 140 is any amino acid
  Variant (141)..(170): Xaa in position 141 to 170 is any or no amino acid
  Variant (172)..(174): Xaa in position 172 to 174 is any amino acid
  Variant (177)..(178): Xaa in position 177 to 178 is any amino acid
  Variant (180)..(181): Xaa in position 180 to 181 is any amino acid
  Variant (183)..(184): Xaa in position 183 to 184 is any amino acid
  Variant (186)..(186): Xaa in position 186 is any amino acid
  Variant (190)..(191): Xaa in position 190 to 191 is any amino acid
  Variant (193)..(193): Xaa in position 193 is any amino acid
  Variant (194)..(194): Xaa in position 194 is any or no amino acid
  Variant (197)..(197): Xaa in position 197 is any amino acid
  Variant (199)..(202): Xaa in position 199 to 202 is any amino acid
  Variant (205)..(226): Xaa in position 205 to 226 is any amino acid
  Variant (227)..(257): Xaa in position 227 to 257 is any or no amino acid
  Variant (259)..(261): Xaa in position 259 to 261 is any amino acid
  Variant (264)..(264): Xaa in position 264 is any amino acid
  Variant (267)..(267): Xaa in position 267 is any amino acid
  Variant (269)..(271): Xaa in position 269 to 271 is any amino acid
  Variant (273)..(282): Xaa in position 273 to 282 is any amino acid
  Variant (284)..(285): Xaa in position 284 to 285 is any amino acid
  Variant (288)..(288): Xaa in position 288 is any amino acid
  Variant (290)..(290): Xaa in position 290 is any amino acid
  Variant (292)..(308): Xaa in position 292 to 308 is any amino acid
  Variant (312)..(314): Xaa in position 312 to 314 is any amino acid
  Variant (321)..(322): Xaa in position 321 to 322 is any amino acid
  Variant (324)..(326): Xaa in position 324 to 326 is any amino acid
  Variant (329)..(340): Xaa in position 329 to 340 is any amino acid
  Variant (341)..(369): Xaa in position 341 to 369 is any or no amino acid
  Variant (371)..(371): Xaa in position 371 is any amino acid
  Variant (373)..(390): Xaa in position 373 to 390 is any amino acid
  Variant (391)..(397): Xaa in position 391 to 397 is any or no amino acid
  Variant (399)..(406): Xaa in position 399 to 406 is any amino acid
  Variant (409)..(409): Xaa in position 409 is any amino acid
  Variant (412)..(413): Xaa in position 412 to 413 is any amino acid
  Variant (417)..(417): Xaa in position 417 is any amino acid
  Variant (419)..(419): Xaa in position 419 is any amino acid
  Variant (421)..(424): Xaa in position 421 to 424 is any amino acid
  Variant (426)..(428): Xaa in position 426 to 428 is any amino acid
  Variant (430)..(435): Xaa in position 430 to 435 is any amino acid
  Variant (437)..(442): Xaa in position 437 to 442 is any amino acid
  Variant (445)..(459): Xaa in position 445 to 459 is any amino acid
  Variant (460)..(477): Xaa in position 460 to 477 is any or no amino acid
  Variant (484)..(485): Xaa in position 484 to 485 is any amino acid
  Variant (489)..(490): Xaa in position 489 to 490 is any amino acid
  Variant (493)..(493): Xaa in position 493 is any amino acid
  Variant (496)..(496): Xaa in position 496 is any amino acid
  Variant (498)..(499): Xaa in position 498 to 499 is any amino acid
  Variant (502)..(503): Xaa in position 502 to 503 is any amino acid
  Variant (505)..(510): Xaa in position 505 to 510 is any amino acid
  Variant (512)..(515): Xaa in position 512 to 515 is any amino acid
  Variant (517)..(519): Xaa in position 517 to 519 is any amino acid
  Variant (521)..(525): Xaa in position 521 to 525 is any amino acid
  Variant (528)..(533): Xaa in position 528 to 533 is any amino acid
  Variant (535)..(538): Xaa in position 535 to 538 is any amino acid
  Variant (540)..(542): Xaa in position 540 to 542 is any amino acid
  Variant (545)..(545): Xaa in position 545 is any amino acid
  Variant (549)..(549): Xaa in position 549 is any amino acid
  Variant (554)..(562): Xaa in position 554 to 562 is any amino acid
  Variant (563)..(578): Xaa in position 563 to 578 is any or no amino acid
  Variant (581)..(581): Xaa in position 581 is any amino acid
  Variant (584)..(584): Xaa in position 584 is any amino acid

SEQ ID NO: 11936 - protein, 36 aa, Artificial sequence; identical to SEQ ID NO: 944
  protein pattern
  Variant (2)..(2): Xaa in position 2 is any or no amino acid
  Variant (8)..(8): Xaa in position 8 is Phe or Leu
  Variant (9)..(9): Xaa in position 9 is any amino acid
  Variant (13)..(13): Xaa in position 13 is any or no amino acid
  Variant (15)..(15): Xaa in position 15 is any or no amino acid
  Variant (17)..(17): Xaa in position 17 is Phe or Tyr
  Variant (18)..(18): Xaa in position 18 is any amino acid
  Variant (21)..(21): Xaa in position 21 is Lys or Arg
  Variant (23)..(24): Xaa in position 23 to 24 is any amino acid
  Variant (27)..(27): Xaa in position 27 is Asp, Glu, Asn or Gln
  Variant (28)..(28): Xaa in position 28 is Ala, Ile or Val
  Variant (30)..(31): Xaa in position 30 to 31 is any amino acid
  Variant (32)..(32): Xaa in position 32 is Phe, Ile, Leu, Met or Val
  Variant (33)..(33): Xaa in position 33 is Ile, Leu or Val
  Variant (34)..(35): Xaa in position 34 to 35 is any amino acid
  Variant (36)..(36): Xaa in position 36 is Phe or Leu

SEQ ID NO: 11937 - protein, 40 aa, Artificial sequence; identical to SEQ ID NO: 945
  protein pattern
  Variant (2)..(3): Xaa in position 2 to 3 is any amino acid
  Variant (4)..(4): Xaa in position 4 is any or no amino acid
  Variant (6)..(6): Xaa in position 6 is Phe or Trp
  Variant (7)..(7): Xaa in position 7 is Pro or Ser
  Variant (11)..(11): Xaa in position 11 is Thr or Val
  Variant (13)..(13): Xaa in position 13 is any amino acid
  Variant (15)..(15): Xaa in position 15 is Asp, Asn or Gln
  Variant (16)..(16): Xaa in position 16 is Ile, Leu or Val
  Variant (17)..(17): Xaa in position 17 is Ala, Asp, Glu, Gln or Ser
  Variant (18)..(18): Xaa in position 18 is Ala, Asp or Pro
  Variant (19)..(19): Xaa in position 19 is Ala or Ser
  Variant (20)..(21): Xaa in position 20 to 21 is any amino acid
  Variant (22)..(22): Xaa in position 22 is Asn, Gln, Ser or Thr
  Variant (24)..(25): Xaa in position 24 to 25 is any amino acid
  Variant (26)..(26): Xaa in position 26 is Phe or Tyr
  Variant (27)..(28): Xaa in position 27 to 28 is any amino acid
  Variant (29)..(29): Xaa in position 29 is Ile, Leu, Met or Val
  Variant (31)..(32): Xaa in position 31 to 32 is any amino acid
  Variant (33)..(33): Xaa in position 33 is Phe or Tyr
  Variant (34)..(34): Xaa in position 34 is Asp or Gly
  Variant (35)..(36): Xaa in position 35 to 36 is any amino acid
  Variant (39)..(39): Xaa in position 39 is any amino acid
  Variant (40)..(40): Xaa in position 40 is Phe, Trp or Tyr

SEQ ID NO: 11938 - protein, 27 aa, Artificial sequence
  protein pattern
  Variant (2)..(2): Xaa in position 2 is any amino acid
  Variant (3)..(5): Xaa in position 3 to 5 is any or no amino acid
  Variant (7)..(7): Xaa in position 7 is any amino acid
  Variant (8)..(8): Xaa in position 8 is Phe or His
  Variant (9)..(9): Xaa in position 9 is Ala, Gly or Ser
  Variant (10)..(10): Xaa in position 10 is Phe, Trp or Tyr
  Variant (11)..(11): Xaa in position 11 is any amino acid
  Variant (12)..(12): Xaa in position 12 is Gly, Asn or Ser
  Variant (14)..(14): Xaa in position 14 is Ile, Leu or Met
  Variant (15)..(16): Xaa in position 15 to 16 is any amino acid
  Variant (17)..(17): Xaa in position 17 is Ala or Gly
  Variant (18)..(18): Xaa in position 18 is Phe or Tyr
  Variant (20)..(20): Xaa in position 20 is any amino acid
  Variant (23)..(23): Xaa in position 23 is Ile, Leu or Val
  Variant (24)..(24): Xaa in position 24 is any amino acid
  Variant (26)..(26): Xaa in position 26 is any amino acid
  Variant (27)..(27): Xaa in position 27 is Ala, Ser or Thr
EXXXXFXXXXXXYXXXXXPXDEXXPXX

SEQ ID NO: 11939 - protein, 53 aa, Artificial sequence; identical to SEQ ID NO: 947
  protein pattern
  Variant (2)..(2): Xaa in position 2 is Asn or Thr
  Variant (3)..(3): Xaa in position 3 is any amino acid
  Variant (4)..(4): Xaa in position 4 is Ala, Ser, Thr or Val
  Variant (5)..(7): Xaa in position 5 to 7 is any amino acid
  Variant (8)..(8): Xaa in position 8 is Ala, Gly or Ser
  Variant (9)..(9): Xaa in position 9 is Cys, Ser or Thr
  Variant (10)..(10): Xaa in position 10 is Ala, Leu or Pro
  Variant (11)..(12): Xaa in position 11 to 12 is any amino acid
  Variant (13)..(13): Xaa in position 13 is Glu or Gly
  Variant (14)..(16): Xaa in position 14 to 16 is any amino acid
  Variant (18)..(22): Xaa in position 18 to 22 is any or no amino acid
  Variant (24)..(24): Xaa in position 24 is any amino acid
  Variant (26)..(26): Xaa in position 26 is Ser or Thr
  Variant (27)..(27): Xaa in position 27 is any amino acid
  Variant (28)..(28): Xaa in position 28 is Asp or Asn
  Variant (29)..(29): Xaa in position 29 is Ala, Asp, Gly, Pro or Ser
  Variant (30)..(30): Xaa in position 30 is any amino acid
  Variant (31)..(31): Xaa in position 31 is Phe or Tyr
  Variant (32)..(32): Xaa in position 32 is Glu or Arg
  Variant (33)..(34): Xaa in position 33 to 34 is any amino acid
  Variant (35)..(35): Xaa in position 35 is Ala, Gly, Ser or Thr
  Variant (36)..(37): Xaa in position 36 to 37 is any amino acid
  Variant (38)..(38): Xaa in position 38 is Ala, Ser or Thr
  Variant (39)..(39): Xaa in position 39 is Phe, Leu or Val
  Variant (40)..(42): Xaa in position 40 to 42 is any amino acid
  Variant (44)..(45): Xaa in position 44 to 45 is any amino acid
  Variant (46)..(46): Xaa in position 46 is Gln or Arg
  Variant (47)..(48): Xaa in position 47 to 48 is any amino acid
  Variant (49)..(49): Xaa in position 49 is Ile or Leu
  Variant (50)..(50): Xaa in position 50 is any amino acid
  Variant (52)..(52): Xaa in position 52 is Phe, Leu, Met or Val
  Variant (53)..(53): Xaa in position 53 is Gly or Pro

SEQ ID NO: 11940 - protein, 26 aa, Artificial sequence
  protein pattern
  Variant (2)..(5): Xaa in position 2 to 5 is any or no amino acid
  Variant (7)..(10): Xaa in position 7 to 10 is any amino acid
  Variant (11)..(11): Xaa in position 11 is any or no amino acid
  Variant (13)..(13): Xaa in position 13 is Phe or Val
  Variant (14)..(14): Xaa in position 14 is Leu or Val
  Variant (15)..(15): Xaa in position 15 is Ala, Gly or Ser
  Variant (18)..(18): Xaa in position 18 is any amino acid
  Variant (22)..(22): Xaa in position 22 is Phe, Trp or Tyr
  Variant (25)..(25): Xaa in position 25 is Phe or Tyr
EXXXXDXXXXXFXXXETXKYLXLLXD

SEQ ID NO: 11941 - protein, 25 aa, Artificial sequence
  protein pattern
  Variant (2)..(2): Xaa in position 2 is any amino acid
  Variant (3)..(3): Xaa in position 3 is Asp, Gly or Asn
  Variant (4)..(4): Xaa in position 4 is any amino acid
  Variant (5)..(5): Xaa in position 5 is Phe or Leu
  Variant (7)..(7): Xaa in position 7 is any amino acid
  Variant (8)..(8): Xaa in position 8 is Leu or Met
  Variant (10)..(10): Xaa in position 10 is any amino acid
  Variant (11)..(11): Xaa in position 11 is Asp or Asn
  Variant (12)..(12): Xaa in position 12 is Leu or Met
  Variant (13)..(13): Xaa in position 13 is Ala or Gly
  Variant (14)..(14): Xaa in position 14 is any amino acid
  Variant (16)..(16): Xaa in position 16 is any or no amino acid
  Variant (18)..(18): Xaa in position 18 is any or no amino acid
  Variant (20)..(20): Xaa in position 20 is Ala or Ser
  Variant (21)..(21): Xaa in position 21 is Phe or Tyr
  Variant (22)..(22): Xaa in position 22 is any amino acid
  Variant (24)..(24): Xaa in position 24 is any amino acid
YXXXXLXXAXXXXXRXLXPXXXTXT

SEQ ID NO: 11942 - protein, 22 aa, Artificial sequence
  protein pattern
  Variant (2)..(5): Xaa in position 2 to 5 is any amino acid
  Variant (6)..(6): Xaa in position 6 is any or no amino acid
  Variant (8)..(8): Xaa in position 8 is Ile or Val
  Variant (9)..(9): Xaa in position 9 is Asp or Glu
  Variant (11)..(13): Xaa in position 11 to 13 is any or no amino acid
  Variant (15)..(15): Xaa in position 15 is Ala, Asp, Ser, Thr or Val
  Variant (16)..(16): Xaa in position 16 is Ser, Thr or Val
  Variant (17)..(17): Xaa in position 17 is Ile, Leu or Val
  Variant (18)..(18): Xaa in position 18 is Ala, Gly or Val
  Variant (19)..(21): Xaa in position 19 to 21 is any amino acid
  Variant (22)..(22): Xaa in position 22 is Asp, Glu, Gly, Asn or Ser
GXXXXXLXXSXXXLXXXXXXXX

SEQ ID NO: 11943 - protein, 15 aa, Artificial sequence
  protein pattern
  Variant (2)..(2): Xaa in position 2 is any amino acid
  Variant (3)..(6): Xaa in position 3 to 6 is any or no amino acid
  Variant (9)..(9): Xaa in position 9 is Ser or Thr
  Variant (12)..(12): Xaa in position 12 is Ala or Gly
  Variant (14)..(14): Xaa in position 14 is Leu or Pro
  Variant (15)..(15): Xaa in position 15 is Phe, Ile, Leu or Met
NXXXXXIFXTEXHXX

SEQ ID NO: 11944 - DNA, 1500 bp, Saccharomyces cerevisiae
  CDS (1)..(1500)
atgtcttacaattttacaggtacgcctacaggcgaaggaacgggtggtaactcgttgacaacagatttgaatacacaatttgacttggccaacatgggatggatcggtgtggcttcagcaggtgtgtggattatggtcccaggtatcggtttattatattctggtttatccaggaaaaagcatgctttatccttgctttgggcctcgatgatggcttccgccgtgtgtattttccaatggtttttctggggatactcattagctttctcacacaacactagaggtaacggttttattggtaccttggaattctttgggtttcgtaacgttttaggagccccatctagtgtcagttctcttcccgatatactgtttgccgtttaccaaggtatgtttgccgcagtcaccggtgccctaatgctaggtggtgcctgcgagagggcaaggttgtttcctatgatggtgttcttgtttttatggatgactattgtttattgtcctattgcatgctgggtctggaatgccgagggttggttggtcaaattgggtagcttggactatgcaggtggtttatgtgtccatttaacatctggacatggtggtctagtttacgctttgatactgggtaagcgtaatgaccctgttacacgtaaagggatgcccaagtacaaaccacattccgtcacctcggtggttttaggcacagtgttcttatggtttggttggatgttctttaacggaggctctgcgggtaatgcaactatacgagcatggtactctattatgtccacaaacttagctgctgcttgcggtggcttgacatggatggttatcgattatttcagatgcggaagaaagtggactacagttggtttgtgttcaggtatcatcgctggcctagtgggtatcaccccagccgccgggttcgtgccaatctggtcagccgttgtcattggtgtggttactggtgcaggatgtaaccttgctgttgacttaaagagtctattgcgcatcgatgatggtctagattgttactctatccatggtgtgggtggttgtattggttctgtattaactggtatctttgctgcagactatgtaaatgccactgcaggctcttacattagtccaattgatggtggctggatcaatcatcactataaacaagttggttatcaattagcaggtatatgcgctgcactagcctggactgttactgtcacatctatcttgcttctaactatgaatgccattccatttttaaaactaagattaagtgctgatgaggaagaattaggtaccgacgctgctcaaattggtgaatttacatacgaggaatccactgcttacatcccagaaccaatcagatctaaaacatcggcacaaatgccacctcctcatgaaaacattgatgataagattgtgggtaacacagacgcagaaaagaattctacgccttccgacgcttcttctactaagaacactgaccatatagtataa

SEQ ID NO: 11945 - protein, 499 aa, Saccharomyces cerevisiae; identical to SEQ ID NO: 1649

SEQ ID NO: 11946 - DNA, 1959 bp, Oryza sativa; identical to SEQ ID NO: 1650
  CDS (151)..(1725)

SEQ ID NO: 11947 - protein, 524 aa, Oryza sativa; identical to SEQ ID NO: 1651

SEQ ID NO: 11948 - DNA, 1431 bp, Oryza sativa; identical to SEQ ID NO: 1652
  CDS (1)..(1431)

SEQ ID NO: 11949 - protein, 476 aa, Oryza sativa; identical to SEQ ID NO: 1653

SEQ ID NO: 11950 - DNA, 1458 bp, Medicago truncatula; identical to SEQ ID NO: 1654
  CDS (1)..(1458)

SEQ ID NO: 11951 - protein, 485 aa, Medicago truncatula; identical to SEQ ID NO: 1655

SEQ ID NO: 11952 - DNA, 1464 bp, Medicago truncatula; identical to SEQ ID NO: 1656
  CDS (1)..(1464)

SEQ ID NO: 11953 - protein, 487 aa, Medicago truncatula; identical to SEQ ID NO: 1657

SEQ ID NO: 11954 - DNA, 1470 bp, Medicago truncatula; identical to SEQ ID NO: 1658
  CDS (1)..(1470)

SEQ ID NO: 11955 - protein, 489 aa, Medicago truncatula; identical to SEQ ID NO: 1659

SEQ ID NO: 11956 - DNA, 1473 bp, Medicago truncatula; identical to SEQ ID NO: 1660
  CDS (1)..(1473)

SEQ ID NO: 11957 - protein, 490 aa, Medicago truncatula; identical to SEQ ID NO: 1661

SEQ ID NO: 11958 - DNA, 1176 bp, Archaeoglobus fulgidus DSM 4304; identical to SEQ ID NO: 1662
  CDS (1)..(1176): transl_table=11

SEQ ID NO: 11959 - protein, 391 aa, Archaeoglobus fulgidus DSM 4304; identical to SEQ ID NO: 1663

SEQ ID NO: 11960 - DNA, 1167 bp, Archaeoglobus fulgidus DSM 4304; identical to SEQ ID NO: 1664
  CDS (1)..(1167): transl_table=11

SEQ ID NO: 11961 - protein, 388 aa, Archaeoglobus fulgidus DSM 4304; identical to SEQ ID NO: 1665

SEQ ID NO: 11962 - DNA, 1533 bp, Ureaplasma parvum serovar 3 str. ATCC 700970; identical to SEQ ID NO: 1666
  CDS (1)..(1533): transl_table=4

SEQ ID NO: 11963 - protein, 510 aa, Ureaplasma parvum serovar 3 str. ATCC 700970; identical to SEQ ID NO: 1667

SEQ ID NO: 11964 - DNA, 1566 bp, Ureaplasma parvum serovar 3 str. ATCC 700970; identical to SEQ ID NO: 1668
  CDS (1)..(1566): transl_table=4

SEQ ID NO: 11965 - protein, 521 aa, Ureaplasma parvum serovar 3 str. ATCC 700970; identical to SEQ ID NO: 1669

SEQ ID NO: 11966 - DNA, 1356 bp, Mesorhizobium loti MAFF303099; identical to SEQ ID NO: 1670
  CDS (1)..(1356): transl_table=11

SEQ ID NO: 11967 - protein, 451 aa, Mesorhizobium loti MAFF303099; identical to SEQ ID NO: 1671

SEQ ID NO: 11968 - DNA, 1530 bp, Sulfolobus solfataricus P2; identical to SEQ ID NO: 1674
  CDS (1)..(1530): transl_table=11

SEQ ID NO: 11969 - protein, 509 aa, Sulfolobus solfataricus P2; identical to SEQ ID NO: 1675

SEQ ID NO: 11970 - DNA, 1218 bp, Clostridium acetobutylicum ATCC 824; identical to SEQ ID NO: 1676
  CDS (1)..(1218): transl_table=11

SEQ ID NO: 11971 - protein, 405 aa, Clostridium acetobutylicum ATCC 824; identical to SEQ ID NO: 1677

SEQ ID NO: 11972 - DNA, 1557 bp, Sulfolobus tokodaii str. 7; identical to SEQ ID NO: 1678
  CDS (1)..(1557): transl_table=11

SEQ ID NO: 11973 - protein, 518 aa, Sulfolobus tokodaii str. 7; identical to SEQ ID NO: 1679

SEQ ID NO: 11974 - DNA, 1296 bp, Yersinia pestis CO92; identical to SEQ ID NO: 1680
  CDS (1)..(1296): transl_table=11

SEQ ID NO: 11975 - protein, 431 aa, Yersinia pestis CO92; identical to SEQ ID NO: 1681

SEQ ID NO: 11976 - DNA, 1287 bp, Salmonella typhimurium LT2; identical to SEQ ID NO: 1682
  CDS (1)..(1287): transl_table=11

SEQ ID NO: 11977 - protein, 428 aa, Salmonella typhimurium LT2; identical to SEQ ID NO: 1683

SEQ ID NO: 11978 - DNA, 1206 bp, Listeria monocytogenes EGD-e; identical to SEQ ID NO: 1684
  CDS (1)..(1206): transl_table=11

SEQ ID NO: 11979 - protein, 401 aa, Listeria monocytogenes EGD-e; identical to SEQ ID NO: 1685

SEQ ID NO: 11980 - DNA, 1206 bp, Listeria innocua Clip11262; identical to SEQ ID NO: 1686
  CDS (1)..(1206): transl_table=11

SEQ ID NO: 11981 - protein, 401 aa, Listeria innocua Clip11262; identical to SEQ ID NO: 1687

SEQ ID NO: 11982 - DNA, 1413 bp, Nostoc sp. PCC 7120; identical to SEQ ID NO: 1688
  CDS (1)..(1413): transl_table=11

SEQ ID NO: 11983 - protein, 470 aa, Nostoc sp. PCC 7120; identical to SEQ ID NO: 1689

SEQ ID NO: 11984 - DNA, 1311 bp, Ralstonia solanacearum GMI1000; identical to SEQ ID NO: 1690
  CDS (1)..(1311): transl_table=11

SEQ ID NO: 11985 - protein, 436 aa, Ralstonia solanacearum GMI1000; identical to SEQ ID NO: 1691

SEQ ID NO: 11986 - DNA, 1350 bp, Agrobacterium tumefaciens str. C58; identical to SEQ ID NO: 1692
  CDS (1)..(1350): transl_table=11

SEQ ID NO: 11987 - protein, 449 aa, Agrobacterium tumefaciens str. C58; identical to SEQ ID NO: 1693

SEQ ID NO: 11988 - DNA, 1302 bp, Brucella melitensis 16M; identical to SEQ ID NO: 1694
  CDS (1)..(1302): transl_table=11

SEQ ID NO: 11989 - protein, 433 aa, Brucella melitensis 16M; identical to SEQ ID NO: 1695

SEQ ID NO: 11990 - DNA, 1494 bp, Schizosaccharomyces pombe 972h-; identical to SEQ ID NO: 1696
  CDS (1)..(1494)

SEQ ID NO: 11991 - protein, 497 aa, Schizosaccharomyces pombe 972h-; identical to SEQ ID NO: 1697

SEQ ID NO: 11992 - DNA, 1539 bp, Schizosaccharomyces pombe 972h-; identical to SEQ ID NO: 1698
  CDS (1)..(1539)

SEQ ID NO: 11993 - protein, 512 aa, Schizosaccharomyces pombe 972h-; identical to SEQ ID NO: 1699

SEQ ID NO: 11994 - DNA, 1554 bp, Schizosaccharomyces pombe 972h-; identical to SEQ ID NO: 1700
  CDS (1)..(1554)

SEQ ID NO: 11995 - protein, 517 aa, Schizosaccharomyces pombe 972h-; identical to SEQ ID NO: 1701

SEQ ID NO: 11996 - DNA, 1317 bp, Corynebacterium glutamicum ATCC 13032; identical to SEQ ID NO: 1702
  CDS (1)..(1317): transl_table=11

SEQ ID NO: 11997 - protein, 438 aa, Corynebacterium glutamicum ATCC 13032; identical to SEQ ID NO: 1703

SEQ ID NO: 11998 - DNA, 1209 bp, Methanosarcina acetivorans C2A; identical to SEQ ID NO: 1704
  CDS (1)..(1209): transl_table=11

SEQ ID NO: 11999 - protein, 402 aa, Methanosarcina acetivorans C2A; identical to SEQ ID NO: 1705

SEQ ID NO: 12000 - DNA, 1347 bp, Streptomyces coelicolor A3(2); identical to SEQ ID NO: 1706
  CDS (1)..(1347): transl_table=11

SEQ ID NO: 12001 - protein, 448 aa, Streptomyces coelicolor A3(2); identical to SEQ ID NO: 1707

SEQ ID NO: 12002 - DNA, 1200 bp, Methanosarcina mazei Go1; identical to SEQ ID NO: 1708
  CDS (1)..(1200): transl_table=11

SEQ ID NO: 12003 - protein, 399 aa, Methanosarcina mazei Go1; identical to SEQ ID NO: 1709

SEQ ID NO: 12004 - DNA, 1476 bp, Xanthomonas axonopodis pv. citri str. 306; identical to SEQ ID NO: 1710
  CDS (1)..(1476): transl_table=11

SEQ ID NO: 12005 - protein, 491 aa, Xanthomonas axonopodis pv. citri str. 306; identical to SEQ ID NO: 1711

SEQ ID NO: 12006 - DNA, 1302 bp, Brucella suis 1330; identical to SEQ ID NO: 1712
  CDS (1)..(1302): transl_table=11

SEQ ID NO: 12007 - protein, 433 aa, Brucella suis 1330; identical to SEQ ID NO: 1713

SEQ ID NO: 12008 - DNA, 1332 bp, Pseudomonas putida KT2440; identical to SEQ ID NO: 1714
  CDS (1)..(1332): transl_table=11

SEQ ID NO: 12009 - protein, 443 aa, Pseudomonas putida KT2440; identical to SEQ ID NO: 1715

SEQ ID NO: 12010 - DNA, 1287 bp, Escherichia coli CFT073; identical to SEQ ID NO: 1716
  CDS (1)..(1287): transl_table=11

SEQ ID NO: 12011 - protein, 428 aa, Escherichia coli CFT073; identical to SEQ ID NO: 1717

SEQ ID NO: 12012 - DNA, 1338 bp, Pseudomonas syringae pv. tomato str. DC3000; identical to SEQ ID NO: 1718
  CDS (1)..(1338): transl_table=11

SEQ ID NO: 12013 - protein, 445 aa, Pseudomonas syringae pv. tomato str. DC3000; identical to SEQ ID NO: 1719

SEQ ID NO: 12014 - DNA, 1341 bp, Streptomyces avermitilis MA-4680; identical to SEQ ID NO: 1720
  CDS (1)..(1341): transl_table=11

SEQ ID NO: 12015 - protein, 446 aa, Streptomyces avermitilis MA-4680; identical to SEQ ID NO: 1721

SEQ ID NO: 12016 - DNA, 1311 bp, Streptomyces avermitilis MA-4680; identical to SEQ ID NO: 1722
  CDS (1)..(1311): transl_table=11

SEQ ID NO: 12017 - protein, 436 aa, Streptomyces avermitilis MA-4680; identical to SEQ ID NO: 1723

SEQ ID NO: 12018 - DNA, 1233 bp, Bacillus cereus ATCC 14579; identical to SEQ ID NO: 1724
  CDS (1)..(1233): transl_table=11

SEQ ID NO: 12019 - protein, 410 aa, Bacillus cereus ATCC 14579; identical to SEQ ID NO: 1725

SEQ ID NO: 12020 - DNA, 1590 bp, Rhodopirellula baltica SH 1; identical to SEQ ID NO: 1726
  CDS (1)..(1590): transl_table=11

SEQ ID NO: 12021 - protein, 529 aa, Rhodopirellula baltica SH 1; identical to SEQ ID NO: 1727

SEQ ID NO: 12022 - DNA, 1239 bp, Bordetella parapertussis 12822; identical to SEQ ID NO: 1728
  CDS (1)..(1239): transl_table=11

SEQ ID NO: 12023 - protein, 412 aa, Bordetella parapertussis 12822; identical to SEQ ID NO: 1729

SEQ ID NO: 12024 - DNA, 1239 bp, Bordetella bronchiseptica RB50; identical to SEQ ID NO: 1730
  CDS (1)..(1239): transl_table=11

SEQ ID NO: 12025 - protein, 412 aa, Bordetella bronchiseptica RB50; identical to SEQ ID NO: 1731

SEQ ID NO: 12026 - DNA, 1311 bp, Chromobacterium violaceum ATCC 12472; identical to SEQ ID NO: 1732
  CDS (1)..(1311): transl_table=11

SEQ ID NO: 12027 - protein, 436 aa, Chromobacterium violaceum ATCC 12472; identical to SEQ ID NO: 1733

SEQ ID NO: 12028 - DNA, 1314 bp, Wolinella succinogenes DSM 1740; identical to SEQ ID NO: 1734
  CDS (1)..(1314): transl_table=11

SEQ ID NO: 12029 - protein, 437 aa, Wolinella succinogenes DSM 1740; identical to SEQ ID NO: 1735

SEQ ID NO: 12030 - DNA, 1437 bp, Gloeobacter violaceus PCC 7421; identical to SEQ ID NO: 1736
  CDS (1)..(1437): transl_table=11

SEQ ID NO: 12031 - protein, 478 aa, Gloeobacter violaceus PCC 7421; identical to SEQ ID NO: 1737

SEQ ID NO: 12032 - DNA, 1320 bp, Photorhabdus luminescens subsp. laumondii TTO1; identical to SEQ ID NO: 1738
  CDS (1)..(1320): transl_table=11

SEQ ID NO: 12033 - protein, 439 aa, Photorhabdus luminescens subsp. laumondii TTO1; identical to SEQ ID NO: 1739

SEQ ID NO: 12034 - DNA, 1332 bp, Rhodopseudomonas palustris CGA009; identical to SEQ ID NO: 1740
  CDS (1)..(1332): transl_table=11

SEQ ID NO: 12035 - protein, 443 aa, Rhodopseudomonas palustris CGA009; identical to SEQ ID NO: 1741

SEQ ID NO: 12036 - DNA, 1470 bp, Geobacter sulfurreducens PCA; identical to SEQ ID NO: 1742
  CDS (1)..(1470): transl_table=11

SEQ ID NO: 12037 - protein, 489 aa, Geobacter sulfurreducens PCA; identical to SEQ ID NO: 1743

SEQ ID NO: 12038 - DNA, 1440 bp, Mycobacterium avium subsp. paratuberculosis K-10; identical to SEQ ID NO: 1744
  CDS (1)..(1440): transl_table=11

SEQ ID NO: 12039 - protein, 479 aa, Mycobacterium avium subsp. paratuberculosis K-10; identical to SEQ ID NO: 1745

SEQ ID NO: 12040 - DNA, 1236 bp, Bacillus cereus ATCC 10987; identical to SEQ ID NO: 1746
  CDS (1)..(1236): transl_table=11

SEQ ID NO: 12041 - protein, 411 aa, Bacillus cereus ATCC 10987; identical to SEQ ID NO: 1747

SEQ ID NO: 12042 - DNA, 1458 bp, Magnaporthe grisea 70-15; identical to SEQ ID NO: 1748
  CDS (1)..(1458)

SEQ ID NO: 12043 - protein, 485 aa, Magnaporthe grisea 70-15; identical to SEQ ID NO: 1749

SEQ ID NO: 12044 - DNA, 1563 bp, Magnaporthe grisea 70-15; identical to SEQ ID NO: 1752
  CDS (1)..(1563)

SEQ ID NO: 12045 - protein, 520 aa, Magnaporthe grisea 70-15; identical to SEQ ID NO: 1753

SEQ ID NO: 12046 - DNA, 1542 bp, Gibberella zeae PH-1; identical to SEQ ID NO: 1754
  CDS (1)..(1542)

SEQ ID NO: 12047 - protein, 513 aa, Gibberella zeae PH-1; identical to SEQ ID NO: 1755

SEQ ID NO: 12048 - DNA, 1401 bp, Gibberella zeae PH-1; identical to SEQ ID NO: 1756
  CDS (1)..(1401)

SEQ ID NO: 12049 - protein, 466 aa, Gibberella zeae PH-1; identical to SEQ ID NO: 1757

SEQ ID NO: 12050 - DNA, 1449 bp, Gibberella zeae PH-1; identical to SEQ ID NO: 1758
  CDS (1)..(1449)

SEQ ID NO: 12051 - protein, 482 aa, Gibberella zeae PH-1; identical to SEQ ID NO: 1759

SEQ ID NO: 12052 - DNA, 1359 bp, Candida glabrata CBS 138; identical to SEQ ID NO: 1760
  CDS (1)..(1359)

SEQ ID NO: 12053 - protein, 452 aa, Candida glabrata CBS 138; identical to SEQ ID NO: 1761

SEQ ID NO: 12054 - DNA, 1437 bp, Candida glabrata CBS 138; identical to SEQ ID NO: 1762
  CDS (1)..(1437)

SEQ ID NO: 12055 - protein, 478 aa, Candida glabrata CBS 138; identical to SEQ ID NO: 1763

SEQ ID NO: 12056 - DNA, 1515 bp, Candida glabrata CBS 138; identical to SEQ ID NO: 1764
  CDS (1)..(1515)

SEQ ID NO: 12057 - protein, 504 aa, Candida glabrata CBS 138; identical to SEQ ID NO: 1765

SEQ ID NO: 12058 - DNA, 1362 bp, Kluyveromyces lactis NRRL Y-1140; identical to SEQ ID NO: 1766
  CDS (1)..(1362)

SEQ ID NO: 12059 - protein, 453 aa, Kluyveromyces lactis NRRL Y-1140; identical to SEQ ID NO: 1767

SEQ ID NO: 12060 - DNA, 1482 bp, Kluyveromyces lactis NRRL Y-1140; identical to SEQ ID NO: 1768
  CDS (1)..(1482)

SEQ ID NO: 12061 - protein, 493 aa, Kluyveromyces lactis NRRL Y-1140; identical to SEQ ID NO: 1769

SEQ ID NO: 12062 - DNA, 1470 bp, Kluyveromyces lactis NRRL Y-1140; identical to SEQ ID NO: 1770
  CDS (1)..(1470)

SEQ ID NO: 12063 - protein, 489 aa, Kluyveromyces lactis NRRL Y-1140; identical to SEQ ID NO: 1771

SEQ ID NO: 12064 - DNA, 1545 bp, Debaryomyces hansenii CBS767; identical to SEQ ID NO: 1772
  CDS (1)..(1545)

SEQ ID NO: 12065 - protein, 514 aa, Debaryomyces hansenii CBS767; identical to SEQ ID NO: 1773

SEQ ID NO: 12066 - DNA, 1578 bp, Debaryomyces hansenii CBS767; identical to SEQ ID NO: 1774
  CDS (1)..(1578)

SEQ ID NO: 12067 - protein, 525 aa, Debaryomyces hansenii CBS767; identical to SEQ ID NO: 1775

SEQ ID NO: 12068 - DNA, 1722 bp, Yarrowia lipolytica CLIB122; identical to SEQ ID NO: 1776
  CDS (1)..(1722)

SEQ ID NO: 12069 - protein, 573 aa, Yarrowia lipolytica CLIB122; identical to SEQ ID NO: 1777

SEQ ID NO: 12070 - DNA, 1368 bp, Yarrowia lipolytica CLIB122; identical to SEQ ID NO: 1778
  CDS (1)..(1368)

SEQ ID NO: 12071 - protein, 455 aa, Yarrowia lipolytica CLIB122; identical to SEQ ID NO: 1779

SEQ ID NO: 12072 - DNA, 1380 bp, Yarrowia lipolytica CLIB122; identical to SEQ ID NO: 1780
  CDS (1)..(1380)

SEQ ID NO: 12073 - protein, 459 aa, Yarrowia lipolytica CLIB122; identical to SEQ ID NO: 1781

SEQ ID NO: 12074 - DNA, 1461 bp, Yarrowia lipolytica CLIB122; identical to SEQ ID NO: 1782
  CDS (1)..(1461)

SEQ ID NO: 12075 - protein, 486 aa, Yarrowia lipolytica CLIB122; identical to SEQ ID NO: 1783

SEQ ID NO: 12076 - DNA, 1362 bp, Yarrowia lipolytica CLIB122; identical to SEQ ID NO: 1784
  CDS (1)..(1362)

SEQ ID NO: 12077 - protein, 453 aa, Yarrowia lipolytica CLIB122; identical to SEQ ID NO: 1785

SEQ ID NO: 12078 - DNA, 1419 bp, Aspergillus nidulans FGSC A4; identical to SEQ ID NO: 1788
  CDS (1)..(1419)

SEQ ID NO: 12079 - protein, 472 aa, Aspergillus nidulans FGSC A4; identical to SEQ ID NO: 1789

SEQ ID NO: 12080 - DNA, 1437 bp, Aspergillus nidulans FGSC A4; identical to SEQ ID NO: 1790
  CDS (1)..(1437)

SEQ ID NO: 12081 - protein, 478 aa, Aspergillus nidulans FGSC A4; identical to SEQ ID NO: 1791

SEQ ID NO: 12082 - DNA, 1635 bp, Aspergillus nidulans FGSC A4; identical to SEQ ID NO: 1792
  CDS (1)..(1635)

SEQ ID NO: 12083 - protein, 544 aa, Aspergillus nidulans FGSC A4; identical to SEQ ID NO: 1793

SEQ ID NO: 12084 - DNA, 1443 bp, Candida albicans SC5314; identical to SEQ ID NO: 1794
  CDS (1)..(1443): transl_table=12

SEQ ID NO: 12085 - protein, 480 aa, Candida albicans SC5314; identical to SEQ ID NO: 1795

SEQ ID NO: 12086 - DNA, 1605 bp, Candida albicans SC5314; identical to SEQ ID NO: 1796
  CDS (1)..(1605): transl_table=12

SEQ ID NO: 12087 - protein, 534 aa, Candida albicans SC5314; identical to SEQ ID NO: 1797

SEQ ID NO: 12088 - DNA, 1608 bp, Candida albicans SC5314; identical to SEQ ID NO: 1798
  CDS (1)..(1608): transl_table=12

SEQ ID NO: 12089 - protein, 535 aa, Candida albicans SC5314; identical to SEQ ID NO: 1799

SEQ ID NO: 12090 - DNA, 1587 bp, Ustilago maydis 521; identical to SEQ ID NO: 1800
  CDS (1)..(1587)

SEQ ID NO: 12091 - protein, 528 aa, Ustilago maydis 521; identical to SEQ ID NO: 1801

SEQ ID NO: 12092 - DNA, 1464 bp, Ustilago maydis 521; identical to SEQ ID NO: 1802
  CDS (1)..(1464)

SEQ ID NO: 12093 - protein, 487 aa, Ustilago maydis 521; identical to SEQ ID NO: 1803

SEQ ID NO: 12094 - DNA, 1491 bp, Cryptococcus neoformans var. neoformans B-3501A; identical to SEQ ID NO: 1804
  CDS (1)..(1491)

SEQ ID NO: 12095 - protein, 496 aa, Cryptococcus neoformans var. neoformans B-3501A; identical to SEQ ID NO: 1805

SEQ ID NO: 12096 - DNA, 1293 bp, Leptospira interrogans serovar Copenhageni str. Fiocruz L1-130; identical to SEQ ID NO: 1806
  CDS (1)..(1293): transl_table=11

SEQ ID NO: 12097 - protein, 430 aa, Leptospira interrogans serovar Copenhageni str. Fiocruz L1-130; identical to SEQ ID NO: 1807

SEQ ID NO: 12098 - DNA, 1341 bp, Thermus thermophilus HB27; identical to SEQ ID NO: 1808
  CDS (1)..(1341): transl_table=11

SEQ ID NO: 12099 - protein, 446 aa, Thermus thermophilus HB27; identical to SEQ ID NO: 1809

SEQ ID NO: 12100 - DNA, 1209 bp, Desulfovibrio vulgaris subsp. vulgaris str. Hildenborough; identical to SEQ ID NO: 1810
  CDS (1)..(1209): transl_table=11

SEQ ID NO: 12101 - protein, 402 aa, Desulfovibrio vulgaris subsp. vulgaris str. Hildenborough; identical to SEQ ID NO: 1811

SEQ ID NO: 12102 - DNA, 1206 bp, Listeria monocytogenes str. 4b F2365; identical to SEQ ID NO: 1812
  CDS (1)..(1206): transl_table=11

SEQ ID NO: 12103 - protein, 401 aa, Listeria monocytogenes str. 4b F2365; identical to SEQ ID NO: 1813

SEQ ID NO: 12104 - DNA, 1233 bp, Bacillus anthracis str. Sterne; identical to SEQ ID NO: 1814
  CDS (1)..(1233): transl_table=11

SEQ ID NO: 12105 - protein, 410 aa, Bacillus anthracis str. Sterne; identical to SEQ ID NO: 1815

SEQ ID NO: 12106 - DNA, 1233 bp, Bacillus thuringiensis serovar konkukian str. 97-27; identical to SEQ ID NO: 1816
  CDS (1)..(1233): transl_table=11

SEQ ID NO: 12107 - protein, 410 aa, Bacillus thuringiensis serovar konkukian str. 97-27; identical to SEQ ID NO: 1817

SEQ ID NO: 12108 - DNA, 1401 bp, Acinetobacter sp. ADP1; identical to SEQ ID NO: 1818
  CDS (1)..(1401): transl_table=11

SEQ ID NO: 12109 - protein, 466 aa, Acinetobacter sp. ADP1; identical to SEQ ID NO: 1819

SEQ ID NO: 12110 - DNA, 1293 bp, Erwinia carotovora subsp. atroseptica SCRI1043; identical to SEQ ID NO: 1820
  CDS (1)..(1293): transl_table=11

SEQ ID NO: 12111 - protein, 430 aa, Erwinia carotovora subsp. atroseptica SCRI1043; identical to SEQ ID NO: 1821

SEQ ID NO: 12112 - DNA, 1212 bp, Bacillus licheniformis ATCC 14580; identical to SEQ ID NO: 1822
  CDS (1)..(1212): transl_table=11

SEQ ID NO: 12113 - protein, 403 aa, Bacillus licheniformis ATCC 14580; identical to SEQ ID NO: 1823

SEQ ID NO: 12114 - DNA, 1233 bp, Bacillus cereus E33L; identical to SEQ ID NO: 1824
  CDS (1)..(1233): transl_table=11

SEQ ID NO: 12115 - protein, 410 aa, Bacillus cereus E33L; identical to SEQ ID NO: 1825

SEQ ID NO: 12116 - DNA, 1335 bp, Burkholderia mallei ATCC 23344; identical to SEQ ID NO: 1826
  CDS (1)..(1335): transl_table=11

SEQ ID NO: 12117 - protein, 444 aa, Burkholderia mallei ATCC 23344; identical to SEQ ID NO: 1827

SEQ ID NO: 12118 - DNA, 1488 bp, Burkholderia pseudomallei K96243; identical to SEQ ID NO: 1828
  CDS (1)..(1488): transl_table=11

SEQ ID NO: 12119 - protein, 495 aa, Burkholderia pseudomallei K96243; identical to SEQ ID NO: 1829

SEQ ID NO: 12120 - DNA, 1443 bp, Methylococcus capsulatus str. Bath; identical to SEQ ID NO: 1830
  CDS (1)..(1443): transl_table=11

SEQ ID NO: 12121 - protein, 480 aa, Methylococcus capsulatus str. Bath; identical to SEQ ID NO: 1831

SEQ ID NO: 12122 - DNA, 1413 bp, Synechococcus elongatus PCC 6301; identical to SEQ ID NO: 1832
  CDS (1)..(1413): transl_table=11

SEQ ID NO: 12123 - protein, 470 aa, Synechococcus elongatus PCC 6301; identical to SEQ ID NO: 1833

SEQ ID NO: 12124 - DNA, 1227 bp, Dehalococcoides ethenogenes 195; identical to SEQ ID NO: 1834
  CDS (1)..(1227): transl_table=11

SEQ ID NO: 12125 - protein, 408 aa, Dehalococcoides ethenogenes 195; identical to SEQ ID NO: 1835

SEQ ID NO: 12126 - DNA, 1338 bp, Pseudomonas syringae pv. syringae B728a; identical to SEQ ID NO: 1836
  CDS (1)..(1338): transl_table=11

SEQ ID NO: 12127 - protein, 445 aa, Pseudomonas syringae pv. syringae B728a; identical to SEQ ID NO: 1837

SEQ ID NO: 12128 - DNA, 1338 bp, Pseudomonas fluorescens Pf-5; identical to SEQ ID NO: 1838
  CDS (1)..(1338): transl_table=11

SEQ ID NO: 12129 - protein, 445 aa, Pseudomonas fluorescens Pf-5; identical to SEQ ID NO: 1839

SEQ ID NO: 12130 - DNA, 1338 bp, Colwellia psychrerythraea 34H; identical to SEQ ID NO: 1840
  CDS (1)..(1338): transl_table=11

SEQ ID NO: 12131 - protein, 445 aa, Colwellia psychrerythraea 34H; identical to SEQ ID NO: 1841

SEQ ID NO: 12132 - DNA, 1338 bp, Pseudomonas syringae pv. phaseolicola 1448A; identical to SEQ ID NO: 1842
  CDS (1)..(1338): transl_table=11

SEQ ID NO: 12133 - protein, 445 aa, Pseudomonas syringae pv. phaseolicola 1448A; identical to SEQ ID NO: 1843

SEQ ID NO: 12134 - DNA, 1542 bp, Ralstonia eutropha JMP134; identical to SEQ ID NO: 1844
  CDS (1)..(1542): transl_table=11

SEQ ID NO: 12135 - protein, 513 aa, Ralstonia eutropha JMP134; identical to SEQ ID NO: 1845

SEQ ID NO: 12136 - DNA, 1194 bp, Methanosarcina barkeri str. Fusaro; identical to SEQ ID NO: 1846
  CDS (1)..(1194): transl_table=11

SEQ ID NO: 12137 - protein, 397 aa, Methanosarcina barkeri str. Fusaro; identical to SEQ ID NO: 1847

SEQ ID NO: 12138 - DNA, 1227 bp, Dehalococcoides sp. CBDB1; identical to SEQ ID NO: 1848
  CDS (1)..(1227): transl_table=11

SEQ ID NO: 12139 - protein, 408 aa, Dehalococcoides sp. CBDB1; identical to SEQ ID NO: 1849

SEQ ID NO: 12140 - DNA, 1407 bp, Thiobacillus denitrificans ATCC 25259; identical to SEQ ID NO: 1850
  CDS (1)..(1407): transl_table=11

SEQ ID NO: 12141 - protein, 468 aa, Thiobacillus denitrificans ATCC 25259; identical to SEQ ID NO: 1851

SEQ ID NO: 12142 - DNA, 1413 bp, Anabaena variabilis ATCC 29413; identical to SEQ ID NO: 1852
  CDS (1)..(1413): transl_table=11

SEQ ID NO: 12143 - protein, 470 aa, Anabaena variabilis ATCC 29413; identical to SEQ ID NO: 1853

SEQ ID NO: 12144 - DNA, 1338 bp, Pseudomonas fluorescens PfO-1; identical to SEQ ID NO: 1854
  CDS (1)..(1338): transl_table=11

SEQ ID NO: 12145 - protein, 445 aa, Pseudomonas fluorescens PfO-1; identical to SEQ ID NO: 1855

SEQ ID NO: 12146 - DNA, 1317 bp, Carboxydothermus hydrogenoformans Z-2901; identical to SEQ ID NO: 1856
  CDS (1)..(1317): transl_table=11

SEQ ID NO: 12147 - protein, 438 aa, Carboxydothermus hydrogenoformans Z-2901; identical to SEQ ID NO: 1857

SEQ ID NO: 12148 - DNA, 1515 bp, Burkholderia sp. 383; identical to SEQ ID NO: 1858
  CDS (1)..(1515): transl_table=11

SEQ ID NO: 12149 - protein, 504 aa, Burkholderia sp. 383; identical to SEQ ID NO: 1859

SEQ ID NO: 12150 - DNA, 1467 bp, Geobacter metallireducens GS-15; identical to SEQ ID NO: 1860
  CDS (1)..(1467): transl_table=11

SEQ ID NO: 12151 - protein, 488 aa, Geobacter metallireducens GS-15; identical to SEQ ID NO: 1861

SEQ ID NO: 12152 - DNA, 1206 bp, Desulfovibrio desulfuricans G20; identical to SEQ ID NO: 1862
  CDS (1)..(1206): transl_table=11

SEQ ID NO: 12153 - protein, 401 aa, Desulfovibrio desulfuricans G20; identical to SEQ ID NO: 1863

SEQ ID NO: 12154 - DNA, 1413 bp, Synechococcus elongatus PCC 7942; identical to SEQ ID NO: 1864
  CDS (1)..(1413): transl_table=11

SEQ ID NO: 12155 - protein, 470 aa, Synechococcus elongatus PCC 7942; identical to SEQ ID NO: 1865

SEQ ID NO: 12156 - DNA, 1296 bp, Rhodospirillum rubrum ATCC 11170; identical to SEQ ID NO: 1866
  CDS (1)..(1296): transl_table=11

SEQ ID NO: 12157 - protein, 431 aa, Rhodospirillum rubrum ATCC 11170; identical to SEQ ID NO: 1867

SEQ ID NO: 12158 - DNA, 1404 bp, Moorella thermoacetica ATCC 39073; identical to SEQ ID NO: 1868
  CDS (1)..(1404): transl_table=11

SEQ ID NO: 12159 - protein, 467 aa, Moorella thermoacetica ATCC 39073; identical to SEQ ID NO: 1869

SEQ ID NO: 12160 - DNA, 1410 bp, Burkholderia thailandensis E264; identical to SEQ ID NO: 1870
  CDS (1)..(1410): transl_table=11

SEQ ID NO: 12161 - protein, 469 aa, Burkholderia thailandensis E264; identical to SEQ ID NO: 1871

SEQ ID NO: 12162 - DNA, 1233 bp, Syntrophus aciditrophicus SB; identical to SEQ ID NO: 1872
  CDS (1)..(1233): transl_table=11

SEQ ID NO: 12163 - protein, 410 aa, Syntrophus aciditrophicus SB; identical to SEQ ID NO: 1873

SEQ ID NO: 12164 - DNA, 1290 bp, Frankia sp. CcI3; identical to SEQ ID NO: 1874
  CDS (1)..(1290): transl_table=11

SEQ ID NO: 12165 - protein, 429 aa, Frankia sp. CcI3; identical to SEQ ID NO: 1875

SEQ ID NO: 12166 - DNA, 1359 bp, Novosphingobium aromaticivorans DSM 12444; identical to SEQ ID NO: 1876
  CDS (1)..(1359): transl_table=11

SEQ ID NO: 12167 - protein, 452 aa, Novosphingobium aromaticivorans DSM 12444; identical to SEQ ID NO: 1877

SEQ ID NO: 12168 - DNA, 1314 bp, Novosphingobium aromaticivorans DSM 12444; identical to SEQ ID NO: 1878
  CDS (1)..(1314): transl_table=11

SEQ ID NO: 12169 - protein, 437 aa, Novosphingobium aromaticivorans DSM 12444; identical to SEQ ID NO: 1879

SEQ ID NO: 12170 - DNA, 1386 bp, Desulfitobacterium hafniense Y51; identical to SEQ ID NO: 1880
  CDS (1)..(1386): transl_table=11

SEQ ID NO: 12171 - protein, 461 aa, Desulfitobacterium hafniense Y51; identical to SEQ ID NO: 1881

SEQ ID NO: 12172 - DNA, 1296 bp, Saccharophagus degradans 2-40; identical to SEQ ID NO: 1882
  CDS (1)..(1296): transl_table=11

SEQ ID NO: 12173 - protein, 431 aa, Saccharophagus degradans 2-40; identical to SEQ ID NO: 1883

SEQ ID NO: 12174 - DNA, 1305 bp, Methylobacillus flagellatus KT; identical to SEQ ID NO: 1884
  CDS (1)..(1305): transl_table=11

SEQ ID NO: 12175 - protein, 434 aa, Methylobacillus flagellatus KT; identical to SEQ ID NO: 1885

SEQ ID NO: 12176 - DNA, 1500 bp, Burkholderia xenovorans LB400; identical to SEQ ID NO: 1886
  CDS (1)..(1500): transl_table=11

SEQ ID NO: 12177 - protein, 499 aa, Burkholderia xenovorans LB400; identical to SEQ ID NO: 1887

SEQ ID NO: 12178 - DNA, 1533 bp, Ralstonia metallidurans CH34; identical to SEQ ID NO: 1888
  CDS (1)..(1533): transl_table=11

SEQ ID NO: 12179 - protein, 510 aa, Ralstonia metallidurans CH34; identical to SEQ ID NO: 1889

SEQ ID NO: 12180 - DNA, 1419 bp, Acidobacteria bacterium Ellin345; identical to SEQ ID NO: 1890
  CDS (1)..(1419): transl_table=11

SEQ ID NO: 12181 - protein, 472 aa, Acidobacteria bacterium Ellin345; identical to SEQ ID NO: 1891

SEQ ID NO: 12182 - DNA, 1392 bp, Myxococcus xanthus DK 1622; identical to SEQ ID NO: 1892
  CDS (1)..(1392): transl_table=11

SEQ ID NO: 12183 - protein, 463 aa, Myxococcus xanthus DK 1622; identical to SEQ ID NO: 1893

SEQ ID NO: 12184 - DNA, 1365 bp, Mesorhizobium sp. BNC1; identical to SEQ ID NO: 1894
  CDS (1)..(1365): transl_table=11

SEQ ID NO: 12185 - protein, 454 aa, Mesorhizobium sp. BNC1; identical to SEQ ID NO: 1895

SEQ ID NO: 12186 - DNA, 1353 bp, Rhodococcus sp. RHA1; identical to SEQ ID NO: 1896
  CDS (1)..(1353): transl_table=11

SEQ ID NO: 12187 - protein, 450 aa, Rhodococcus sp. RHA1; identical to SEQ ID NO: 1897

SEQ ID NO: 12188 - DNA, 1347 bp, Rhodococcus sp. RHA1; identical to SEQ ID NO: 1898
  CDS (1)..(1347): transl_table=11

SEQ ID NO: 12189 - protein, 448 aa, Rhodococcus sp. RHA1; identical to SEQ ID NO: 1899

SEQ ID NO: 12190 - DNA, 1368 bp, Rhodococcus sp. RHA1; identical to SEQ ID NO: 1900
  CDS (1)..(1368): transl_table=11

SEQ ID NO: 12191 - protein, 455 aa, Rhodococcus sp. RHA1; identical to SEQ ID NO: 1901

SEQ ID NO: 12192 - DNA, 1299 bp, Haemophilus somnus 129PT; identical to SEQ ID NO: 1902
  CDS (1)..(1299): transl_table=11

SEQ ID NO: 12193 - protein, 432 aa, Haemophilus somnus 129PT; identical to SEQ ID NO: 1903

SEQ ID NO: 12194 - DNA, 1401 bp, Shewanella sp. MR-4; identical to SEQ ID NO: 1904
  CDS (1)..(1401): transl_table=11

SEQ ID NO: 12195 - protein, 466 aa, Shewanella sp. MR-4; identical to SEQ ID NO: 1905

SEQ ID NO: 12196 - DNA, 1401 bp, Shewanella sp. MR-7; identical to SEQ ID NO: 1906
  CDS (1)..(1401): transl_table=11

SEQ ID NO: 12197 - protein, 466 aa, Shewanella sp. MR-7; identical to SEQ ID NO: 1907

SEQ ID NO: 12198 - DNA, 1329 bp, Pseudomonas aeruginosa UCBPP-PA14; identical to SEQ ID NO: 1908
  CDS (1)..(1329): transl_table=11

SEQ ID NO: 12199 - protein, 442 aa, Pseudomonas aeruginosa UCBPP-PA14; identical to SEQ ID NO: 1909

SEQ ID NO: 12200 - DNA, 1197 bp, Leuconostoc mesenteroides subsp. mesenteroides ATCC 8293; identical to SEQ ID NO: 1910
  CDS (1)..(1197): transl_table=11

SEQ ID NO: 12201 - protein, 398 aa, Leuconostoc mesenteroides subsp. mesenteroides ATCC 8293; identical to SEQ ID NO: 1911

SEQ ID NO: 12202 - DNA, 1416 bp, Solibacter usitatus Ellin6076; identical to SEQ ID NO: 1912
  CDS (1)..(1416): transl_table=11

SEQ ID NO: 12203 - protein, 471 aa, Solibacter usitatus Ellin6076; identical to SEQ ID NO: 1913

SEQ ID NO: 12204 - DNA, 1311 bp, Magnetococcus sp. MC-1; identical to SEQ ID NO: 1914
  CDS (1)..(1311): transl_table=11

SEQ ID NO: 12205 - protein, 436 aa, Magnetococcus sp. MC-1; identical to SEQ ID NO: 1915

SEQ ID NO: 12206 - DNA, 1311 bp, Magnetococcus sp. MC-1; identical to SEQ ID NO: 1916
  CDS (1)..(1311): transl_table=11

SEQ ID NO: 12207 - protein, 436 aa, Magnetococcus sp. MC-1; identical to SEQ ID NO: 1917

SEQ ID NO: 12208 - DNA, 1401 bp, Shewanella sp. ANA-3; identical to SEQ ID NO: 1918
  CDS (1)..(1401): transl_table=11

SEQ ID NO: 12209 - protein, 466 aa, Shewanella sp. ANA-3; identical to SEQ ID NO: 1919

SEQ ID NO: 12210 - DNA, 1278 bp, Mycobacterium avium 104; identical to SEQ ID NO: 1920
  CDS (1)..(1278): transl_table=11

SEQ ID NO: 12211 - protein, 425 aa, Mycobacterium avium 104; identical to SEQ ID NO: 1921

SEQ ID NO: 12212 - DNA, 1434 bp, Mycobacterium avium 104; identical to SEQ ID NO: 1922
  CDS (1)..(1434): transl_table=11

SEQ ID NO: 12213 - protein, 477 aa, Mycobacterium avium 104; identical to SEQ ID NO: 1923

SEQ ID NO: 12214 - DNA, 1251 bp, Mycobacterium smegmatis str. MC2 155; identical to SEQ ID NO: 1924
  CDS (1)..(1251): transl_table=11

SEQ ID NO: 12215 - protein, 416 aa, Mycobacterium smegmatis str. MC2 155; identical to SEQ ID NO: 1925

SEQ ID NO: 12216 - DNA, 1326 bp, Nocardioides sp. JS614; identical to SEQ ID NO: 1926
  CDS (1)..(1326): transl_table=11

SEQ ID NO: 12217 - protein, 441 aa, Nocardioides sp. JS614; identical to SEQ ID NO: 1927

SEQ ID NO: 12218 - DNA, 1425 bp, Nostoc punctiforme PCC 73102; identical to SEQ ID NO: 1928
  CDS (1)..(1425): transl_table=11

SEQ ID NO: 12219 - protein, 474 aa, Nostoc punctiforme PCC 73102; identical to SEQ ID NO: 1929

SEQ ID NO: 12220 - DNA, 1206 bp, Listeria monocytogenes str. 4b H7858; identical to SEQ ID NO: 1930
  CDS (1)..(1206): transl_table=11

SEQ ID NO: 12221 - protein, 401 aa, Listeria monocytogenes str. 4b H7858; identical to SEQ ID NO: 1931

SEQ ID NO: 12222 - DNA, 1452 bp, Rubrivivax gelatinosus PM1; identical to SEQ ID NO: 1932
  CDS (1)..(1452): transl_table=11

SEQ ID NO: 12223 - protein, 483 aa, Rubrivivax gelatinosus PM1; identical to SEQ ID NO: 1933

SEQ ID NO: 12224 - DNA, 1500 bp, Burkholderia vietnamiensis G4; identical to SEQ ID NO: 1934
  CDS (1)..(1500): transl_table=11

SEQ ID NO: 12225 - protein, 499 aa, Burkholderia vietnamiensis G4; identical to SEQ ID NO: 1935

SEQ ID NO: 12226 - DNA, 1284 bp, Croceibacter atlanticus HTCC2559; identical to SEQ ID NO: 1936
  CDS (1)..(1284): transl_table=11

SEQ ID NO: 12227 - protein, 427 aa, Croceibacter atlanticus HTCC2559; identical to SEQ ID NO: 1937

SEQ ID NO: 12228 - DNA, 1227 bp, Dehalococcoides sp. BAV1; identical to SEQ ID NO: 1938
  CDS (1)..(1227): transl_table=11

SEQ ID NO: 12229 - protein, 408 aa, Dehalococcoides sp. BAV1; identical to SEQ ID NO: 1939

SEQ ID NO: 12230 - DNA, 1284 bp, Flavobacteria bacterium BBFL7; identical to SEQ ID NO: 1940
  CDS (1)..(1284): transl_table=11

SEQ ID NO: 12231 - protein, 427 aa, Flavobacteria bacterium BBFL7; identical to SEQ ID NO: 1941

SEQ ID NO: 12232 - DNA, 1311 bp, marine gamma proteobacterium HTCC2207; identical to SEQ ID NO: 1942
  CDS (1)..(1311): transl_table=11

SEQ ID NO: 12233 - protein, 436 aa, marine gamma proteobacterium HTCC2207; identical to SEQ ID NO: 1943

SEQ ID NO: 12234 - DNA, 1428 bp, Acidovorax sp. JS42; identical to SEQ ID NO: 1944
  CDS (1)..(1428): transl_table=11

SEQ ID NO: 12235 - protein, 475 aa, Acidovorax sp. JS42; identical to SEQ ID NO: 1945

SEQ ID NO: 12236 - DNA, 1296 bp, marine gamma proteobacterium HTCC2143; identical to SEQ ID NO: 1946
  CDS (1)..(1296): transl_table=11

SEQ ID NO: 12237 - protein, 431 aa, marine gamma proteobacterium HTCC2143; identical to SEQ ID NO: 1947

SEQ ID NO: 12238 - DNA, 1308 bp, marine gamma proteobacterium HTCC2080; identical to SEQ ID NO: 1948
  CDS (1)..(1308): transl_table=11

SEQ ID NO: 12239 - protein, 435 aa, marine gamma proteobacterium HTCC2080; identical to SEQ ID NO: 1949

SEQ ID NO: 12240 - DNA, 1305 bp, Pseudomonas putida GB-1; identical to SEQ ID NO: 1950
  CDS (1)..(1305): transl_table=11

SEQ ID NO: 12241 - protein, 434 aa, Pseudomonas putida GB-1; identical to SEQ ID NO: 1951

SEQ ID NO: 12242 - DNA, 1332 bp, Pseudomonas putida GB-1; identical to SEQ ID NO: 1952
  CDS (1)..(1332): transl_table=11

SEQ ID NO: 12243 - protein, 443 aa, Pseudomonas putida GB-1; identical to SEQ ID NO: 1953

SEQ ID NO: 12244 - DNA, 1401 bp, Gibberella fujikuroi; identical to SEQ ID NO: 1954
  CDS (1)..(1401)

SEQ ID NO: 12245 - protein, 466 aa, Gibberella fujikuroi; identical to SEQ ID NO: 1955

SEQ ID NO: 12246 - DNA, 1386 bp, Gibberella fujikuroi; identical to SEQ ID NO: 1956
  CDS (1)..(1386)

SEQ ID NO: 12247 - protein, 461 aa, Gibberella fujikuroi; identical to SEQ ID NO: 1957

SEQ ID NO: 12248 - DNA, 1542 bp, Gibberella fujikuroi; identical to SEQ ID NO: 1958
  CDS (1)..(1542)

SEQ ID NO: 12249 - protein, 513 aa, Gibberella fujikuroi; identical to SEQ ID NO: 1959

SEQ ID NO: 12250 - DNA, 1654 bp, Glomus intraradices; identical to SEQ ID NO: 1960
  CDS (143)..(1582)

SEQ ID NO: 12251 - protein, 479 aa, Glomus intraradices; identical to SEQ ID NO: 1961

SEQ ID NO: 12252 - DNA, 2279 bp, Azotobacter vinelandii; identical to SEQ ID NO: 1962
  CDS (850)..(2160): transl_table=11

SEQ ID NO: 12253 - protein, 436 aa, Azotobacter vinelandii; identical to SEQ ID NO: 1963

SEQ ID NO: 12254 - DNA, 1317 bp, Azospirillum brasilense; identical to SEQ ID NO: 1964
  CDS (1)..(1317): transl_table=11

SEQ ID NO: 12255 - protein, 438 aa, Azospirillum brasilense; identical to SEQ ID NO: 1965

SEQ ID NO: 12256 - DNA, 1365 bp, Ostreococcus tauri; identical to SEQ ID NO: 1966
  CDS (1)..(1365)

SEQ ID NO: 12257 - protein, 454 aa, Ostreococcus tauri; identical to SEQ ID NO: 1967

SEQ ID NO: 12258 - DNA, 1437 bp, Aspergillus oryzae; identical to SEQ ID NO: 1968
  CDS (1)..(1437)

SEQ ID NO: 12259 - protein, 478 aa, Aspergillus oryzae; identical to SEQ ID NO: 1969

SEQ ID NO: 12260 - DNA, 1422 bp, Aspergillus oryzae; identical to SEQ ID NO: 1970
  CDS (1)..(1422)

SEQ ID NO: 12261 - protein, 473 aa, Aspergillus oryzae; identical to SEQ ID NO: 1971

SEQ ID NO: 12262 - DNA, 1350 bp, Aspergillus oryzae; identical to SEQ ID NO: 1972
  CDS (1)..(1350)

SEQ ID NO: 12263 - protein, 449 aa, Aspergillus oryzae; identical to SEQ ID NO: 1973

SEQ ID NO: 12264 - DNA, 1686 bp, Aspergillus oryzae; identical to SEQ ID NO: 1974
  CDS (1)..(1686)

SEQ ID NO: 12265 - protein, 561 aa, Aspergillus oryzae; identical to SEQ ID NO: 1975

SEQ ID NO: 12266 - DNA, 1533 bp, Herbaspirillum seropedicae; identical to SEQ ID NO: 1976
  CDS (1)..(1533): transl_table=11

SEQ ID NO: 12267 - protein, 510 aa, Herbaspirillum seropedicae; identical to SEQ ID NO: 1977

SEQ ID NO: 12268 - DNA, 1852 bp, Triticum aestivum; identical to SEQ ID NO: 1978
  CDS (45)..(1529)

SEQ ID NO: 12269 - protein, 494 aa, Triticum aestivum; identical to SEQ ID NO: 1979

SEQ ID NO: 12270 - DNA, 1503 bp, Pichia angusta; identical to SEQ ID NO: 1980
  CDS (1)..(1503)

SEQ ID NO: 12271 - protein, 500 aa, Pichia angusta; identical to SEQ ID NO: 1981

SEQ ID NO: 12272 - DNA, 1470 bp, Saccharomyces cerevisiae; identical to SEQ ID NO: 1982
  CDS (1)..(1470)

SEQ ID NO: 12273 - protein, 489 aa, Saccharomyces cerevisiae; identical to SEQ ID NO: 1983

SEQ ID NO: 12274 - DNA, 1702 bp, Camellia sinensis; identical to SEQ ID NO: 1984
  CDS (63)..(1604)

SEQ ID NO: 12275 - protein, 513 aa, Camellia sinensis; identical to SEQ ID NO: 1985

SEQ ID NO: 12276 - DNA, 1521 bp, Triticum aestivum; identical to SEQ ID NO: 1986
  CDS (24)..(1436)

SEQ ID NO: 12277 - protein, 470 aa, Triticum aestivum; identical to SEQ ID NO: 1987

SEQ ID NO: 12278 - DNA, 1392 bp, Acetobacter diazotrophicus; identical to SEQ ID NO: 1988
  CDS (1)..(1392): transl_table=11

SEQ ID NO: 12279 - protein, 463 aa, Acetobacter diazotrophicus; identical to SEQ ID NO: 1989

SEQ ID NO: 12280 - DNA, 1434 bp, Hebeloma cylindrosporum; identical to SEQ ID NO: 1990
  CDS (1)..(1434)

SEQ ID NO: 12281 - protein, 477 aa, Hebeloma cylindrosporum; identical to SEQ ID NO: 1991

SEQ ID NO: 12282 - DNA, 1317 bp, Pseudomonas stutzeri; identical to SEQ ID NO: 1992
  CDS (1)..(1317): transl_table=11

SEQ ID NO: 12283 - protein, 438 aa, Pseudomonas stutzeri; identical to SEQ ID NO: 1993

SEQ ID NO: 12284 - DNA, 1194 bp, Methanosarcina mazei; identical to SEQ ID NO: 1994
  CDS (1)..(1194): transl_table=11

SEQ ID NO: 12285 - protein, 397 aa, Methanosarcina mazei; identical to SEQ ID NO: 1995

SEQ ID NO: 12286 - DNA, 1452 bp, Tuber borchii; identical to SEQ ID NO: 1996
  CDS (1)..(1452)

SEQ ID NO: 12287 - protein, 483 aa, Tuber borchii; identical to SEQ ID NO: 1997

SEQ ID NO: 12288 - DNA, 1479 bp, Hebeloma cylindrosporum; identical to SEQ ID NO: 1998
  CDS (1)..(1479)

SEQ ID NO: 12289 - protein, 492 aa, Hebeloma cylindrosporum; identical to SEQ ID NO: 1999

SEQ ID NO: 12290 - DNA, 1416 bp, Hebeloma cylindrosporum; identical to SEQ ID NO: 2000
  CDS (1)..(1416)

SEQ ID NO: 12291 - protein, 471 aa, Hebeloma cylindrosporum; identical to SEQ ID NO: 2001

SEQ ID NO: 12292 - DNA, 1587 bp, Ustilago maydis; identical to SEQ ID NO: 2002
  CDS (1)..(1587)

SEQ ID NO: 12293 - protein, 528 aa, Ustilago maydis; identical to SEQ ID NO: 2003

SEQ ID NO: 12294 - DNA, 1731 bp, Brassica napus; identical to SEQ ID NO: 2004
  CDS (1)..(1560)
  misc_feature (1591)..(1591): k is g or t

SEQ ID NO: 12295 - protein, 519 aa, Brassica napus; identical to SEQ ID NO: 2005

SEQ ID NO: 12296 - DNA, 1482 bp, Ustilago violacea; identical to SEQ ID NO: 2006
  CDS (1)..(1482)

SEQ ID NO: 12297 - protein, 493 aa, Ustilago violacea; identical to SEQ ID NO: 2007

SEQ ID NO: 12298 - DNA, 1858 bp, Solanum lycopersicum; identical to SEQ ID NO: 2008
  CDS (13)..(1557)

SEQ ID NO: 12299 - protein, 514 aa, Solanum lycopersicum; identical to SEQ ID NO: 2009

SEQ ID NO: 12300 - DNA, 1272 bp, Aquifex aeolicus; identical to SEQ ID NO: 2010
  CDS (1)..(1272): transl_table=11

SEQ ID NO: 12301 - protein, 423 aa, Aquifex aeolicus; identical to SEQ ID NO: 2011

SEQ ID NO: 12302 - DNA, 1434 bp, Mycobacterium bovis; identical to SEQ ID NO: 2012
  CDS (1)..(1434): transl_table=11

SEQ ID NO: 12303 - protein, 477 aa, Mycobacterium bovis; identical to SEQ ID NO: 2013

SEQ ID NO: 12304 - DNA, 1479 bp, Saccharomyces cerevisiae; identical to SEQ ID NO: 2014
  CDS (1)..(1479)

SEQ ID NO: 12305 - protein, 492 aa, Saccharomyces cerevisiae; identical to SEQ ID NO: 2015

SEQ ID NO: 12306 - DNA, 1470 bp, Saccharomyces cerevisiae; identical to SEQ ID NO: 2016
  CDS (1)..(1470)

SEQ ID NO: 12307 - protein, 489 aa, Saccharomyces cerevisiae; identical to SEQ ID NO: 2017

SEQ ID NO: 12308 - DNA, 1215 bp, Bacillus subtilis; identical to SEQ ID NO: 2018
  CDS (1)..(1215): transl_table=11

SEQ ID NO: 12309 - protein, 404 aa, Bacillus subtilis; identical to SEQ ID NO: 2019

SEQ ID NO: 12310 - DNA, 1224 bp, Methanobacterium thermoautotrophicum; identical to SEQ ID NO: 2020
  CDS (1)..(1224): transl_table=11

SEQ ID NO: 12311 - protein, 407 aa, Methanobacterium thermoautotrophicum; identical to SEQ ID NO: 2021

SEQ ID NO: 12312 - DNA, 1239 bp, Methanobacterium thermoautotrophicum; identical to SEQ ID NO: 2022
  CDS (1)..(1239): transl_table=11

SEQ ID NO: 12313 - protein, 412 aa, Methanobacterium thermoautotrophicum; identical to SEQ ID NO: 2023

SEQ ID NO: 12314 - DNA, 1545 bp, Arabidopsis thaliana; identical to SEQ ID NO: 2024
  CDS (1)..(1545)

SEQ ID NO: 12315 - protein, 514 aa, Arabidopsis thaliana; identical to SEQ ID NO: 2025

SEQ ID NO: 12316 - DNA, 1428 bp, Arabidopsis thaliana; identical to SEQ ID NO: 2026
  CDS (1)..(1428)

SEQ ID NO: 12317 - protein, 475 aa, Arabidopsis thaliana; identical to SEQ ID NO: 2027

SEQ ID NO: 12318 - DNA, 1491 bp, Arabidopsis thaliana; identical to SEQ ID NO: 2028
  CDS (1)..(1491)

SEQ ID NO: 12319 - protein, 496 aa, Arabidopsis thaliana; identical to SEQ ID NO: 2029

SEQ ID NO: 12320 - DNA, 1497 bp, Arabidopsis thaliana; identical to SEQ ID NO: 2030
  CDS (1)..(1497)

SEQ ID NO: 12321 - protein, 498 aa, Arabidopsis thaliana; identical to SEQ ID NO: 2031

SEQ ID NO: 12322 - DNA, 1506 bp, Arabidopsis thaliana; identical to SEQ ID NO: 2032
  CDS (1)..(1506)

SEQ ID NO: 12323 - protein, 501 aa, Arabidopsis thaliana; identical to SEQ ID NO: 2033

SEQ ID NO: 12324 - DNA, 1515 bp, Arabidopsis thaliana; identical to SEQ ID NO: 2034
  CDS (1)..(1515)

SEQ ID NO: 12325 - protein, 504 aa, Arabidopsis thaliana; identical to SEQ ID NO: 2035

SEQ ID NO: 12326 - DNA, 1494 bp, Oryza sativa; identical to SEQ ID NO: 2036
  CDS (1)..(1494)

SEQ ID NO: 12327 - protein, 497 aa, Oryza sativa; identical to SEQ ID NO: 2037

SEQ ID NO: 12328 - DNA, 1506 bp, Oryza sativa; identical to SEQ ID NO: 2038
  CDS (1)..(1506)

SEQ ID NO: 12329 - protein, 501 aa, Oryza sativa; identical to SEQ ID NO: 2039

SEQ ID NO: 12330 - DNA, 1497 bp, Oryza sativa; identical to SEQ ID NO: 2040
  CDS (1)..(1497)

SEQ ID NO: 12331 - protein, 498 aa, Oryza sativa; identical to SEQ ID NO: 2041

SEQ ID NO: 12332 - DNA, 1443 bp, Oryza sativa; identical to SEQ ID NO: 2042
  CDS (1)..(1443)

SEQ ID NO: 12333 - protein, 480 aa, Oryza sativa; identical to SEQ ID NO: 2043

SEQ ID NO: 12334 - DNA, 1497 bp, Oryza sativa; identical to SEQ ID NO: 2044
  CDS (1)..(1497)

SEQ ID NO: 12335 - protein, 498 aa, Oryza sativa; identical to SEQ ID NO: 2045

SEQ ID NO: 12336 - DNA, 1491 bp, Oryza sativa; identical to SEQ ID NO: 2046
  CDS (1)..(1491)

SEQ ID NO: 12337 - protein, 496 aa, Oryza sativa; identical to SEQ ID NO: 2047

SEQ ID NO: 12338 - DNA, 1440 bp, Oryza sativa; identical to SEQ ID NO: 2048
  CDS (1)..(1440)

SEQ ID NO: 12339 - protein, 479 aa, Oryza sativa; identical to SEQ ID NO: 2049

SEQ ID NO: 12340 - DNA, 1497 bp, Oryza sativa; identical to SEQ ID NO: 2050
  CDS (1)..(1497)

SEQ ID NO: 12341 - protein, 498 aa, Oryza sativa; identical to SEQ ID NO: 2051

SEQ ID NO: 12342 - DNA, 1461 bp, Oryza sativa; identical to SEQ ID NO: 2052
  CDS (1)..(1461)

SEQ ID NO: 12343 - protein, 486 aa, Oryza sativa; identical to SEQ ID NO: 2053

SEQ ID NO: 12344 - DNA, 1377 bp, Oryza sativa; identical to SEQ ID NO: 2054
  CDS (1)..(1377)

SEQ ID NO: 12345 - protein, 458 aa, Oryza sativa; identical to SEQ ID NO: 2055

SEQ ID NO: 12346 - DNA, 1500 bp, Saccharomyces cerevisiae; identical to SEQ ID NO: 1648
  CDS (1)..(1500)

SEQ ID NO: 12347 - protein, 499 aa, Saccharomyces cerevisiae; identical to SEQ ID NO: 1649

SEQ ID NO: 12348 - DNA, 1512 bp, Brassica napus; identical to SEQ ID NO: 2056
  CDS (1)..(1512)

SEQ ID NO: 12349 - protein, 503 aa, Brassica napus; identical to SEQ ID NO: 2057

SEQ ID NO: 12350 - DNA, 25 bp, Artificial sequence
  primer
atgtcttacaattttacaggtacgc

SEQ ID NO: 12351 - DNA, 26 bp, Artificial sequence
  primer
ttatactatatggtcagtgttcttag

SEQ ID NO: 12352 - protein, 543 aa, Artificial sequence; identical to SEQ ID NO: 2060
  consensus sequence
  Variant (2)..(3): Xaa in position 2 to 3 is any amino acid
  Variant (5)..(5): Xaa in position 5 is any amino acid
  Variant (6)..(6): Xaa in position 6 is any or no amino acid
  Variant (9)..(12): Xaa in position 9 to 12 is any amino acid
  Variant (14)..(14): Xaa in position 14 is any amino acid
  Variant (16)..(17): Xaa in position 16 to 17 is any amino acid
  Variant (19)..(19): Xaa in position 19 is any amino acid
  Variant (21)..(22): Xaa in position 21 to 22 is any amino acid
  Variant (24)..(39): Xaa in position 24 to 39 is any amino acid
  Variant (41)..(43): Xaa in position 41 to 43 is any amino acid
  Variant (46)..(48): Xaa in position 46 to 48 is any amino acid
  Variant (50)..(55): Xaa in position 50 to 55 is any amino acid
  Variant (56)..(65): Xaa in position 56 to 65 is any or no amino acid
  Variant (67)..(79): Xaa in position 67 to 79 is any amino acid
  Variant (80)..(110): Xaa in position 80 to 110 is any or no amino acid
  Variant (112)..(117): Xaa in position 112 to 117 is any amino acid
  Variant (118)..(118): Xaa in position 118 is any or no amino acid
  Variant (120)..(121): Xaa in position 120 to 121 is any amino acid
  Variant (124)..(125): Xaa in position 124 to 125 is any amino acid
  Variant (127)..(131): Xaa in position 127 to 131 is any amino acid
  Variant (133)..(136): Xaa in position 133 to 136 is any amino acid
  Variant (137)..(137): Xaa in position 137 is any or no amino acid
  Variant (139)..(146): Xaa in position 139 to 146 is any amino acid
  Variant (148)..(150): Xaa in position 148 to 150 is any amino acid
  Variant (152)..(155): Xaa in position 152 to 155 is any amino acid
  Variant (157)..(157): Xaa in position 157 is any amino acid
  Variant (159)..(163): Xaa in position 159 to 163 is any amino acid
  Variant (165)..(165): Xaa in position 165 is any amino acid
  Variant (166)..(185): Xaa in position 166 to 185 is any or no amino acid
  Variant (187)..(190): Xaa in position 187 to 190 is any amino acid
  Variant (191)..(201): Xaa in position 191 to 201 is any or no amino acid
  Variant (203)..(204): Xaa in position 203 to 204 is any amino acid
  Variant (206)..(214): Xaa in position 206 to 214 is any amino acid
  Variant (219)..(220): Xaa in position 219 to 220 is any amino acid
  Variant (223)..(225): Xaa in position 223 to 225 is any amino acid
  Variant (227)..(229): Xaa in position 227 to 229 is any amino acid
  Variant (231)..(236): Xaa in position 231 to 236 is any amino acid
  Variant (238)..(238): Xaa in position 238 is any amino acid
  Variant (240)..(245): Xaa in position 240 to 245 is any amino acid
  Variant (246)..(295): Xaa in position 246 to 295 is any or no amino acid
  Variant (298)..(301): Xaa in position 298 to 301 is any amino acid
  Variant (302)..(304): Xaa in position 302 to 304 is any or no amino acid
  Variant (306)..(308): Xaa in position 306 to 308 is any amino acid
  Variant (311)..(311): Xaa in position 311 is any amino acid
  Variant (314)..(314): Xaa in position 314 is any amino acid
  Variant (315)..(315): Xaa in position 315 is any or no amino acid
  Variant (319)..(319): Xaa in position 319 is any amino acid
  Variant (322)..(330): Xaa in position 322 to 330 is any amino acid
  Variant (331)..(346): Xaa in position 331 to 346 is any or no amino acid
  Variant (348)..(350): Xaa in position 348 to 350 is any amino acid
  Variant (352)..(361): Xaa in position 352 to 361 is any amino acid
  Variant (363)..(375): Xaa in position 363 to 375 is any amino acid
  Variant (376)..(378): Xaa in position 376 to 378 is any or no amino acid
  Variant (380)..(382): Xaa in position 380 to 382 is any amino acid
  Variant (384)..(385): Xaa in position 384 to 385 is any amino acid
  Variant (386)..(386): Xaa in position 386 is any or no amino acid
  Variant (390)..(390): Xaa in position 390 is any amino acid
  Variant (394)..(395): Xaa in position 394 to 395 is any amino acid
  Variant (397)..(397): Xaa in position 397 is any amino acid
  Variant (399)..(406): Xaa in position 399 to 406 is any amino acid
  Variant (408)..(424): Xaa in position 408 to 424 is any amino acid
  Variant (425)..(431): Xaa in position 425 to 431 is any or no amino acid
  Variant (434)..(434): Xaa in position 434 is any amino acid
  Variant (437)..(440): Xaa in position 437 to 440 is any amino acid
  Variant (443)..(444): Xaa in position 443 to 444 is any amino acid
  Variant (446)..(447): Xaa in position 446 to 447 is any amino acid
  Variant (449)..(452): Xaa in position 449 to 452 is any amino acid
  Variant (454)..(454): Xaa in position 454 is any amino acid
  Variant (457)..(469): Xaa in position 457 to 469 is any amino acid
  Variant (470)..(489): Xaa in position 470 to 489 is any or no amino acid
  Variant (491)..(517): Xaa in position 491 to 517 is any amino acid
  Variant (518)..(521): Xaa in position 518 to 521 is any or no amino acid
  Variant (523)..(525): Xaa in position 523 to 525 is any amino acid
  Variant (526)..(527): Xaa in position 526 to 527 is any or no amino acid
  Variant (529)..(529): Xaa in position 529 is any amino acid
  Variant (530)..(530): Xaa in position 530 is any or no amino acid
  Variant (532)..(532): Xaa in position 532 is any amino acid
  Variant (534)..(538): Xaa in position 534 to 538 is any amino acid
  Variant (539)..(539): Xaa in position 539 is any or no amino acid
  Variant (541)..(542): Xaa in position 541 to 542 is any amino acid

SEQ ID NO: 12353 - protein, 13 aa, Artificial sequence
  protein pattern
  Variant (2)..(2): Xaa in position 2 is Ala or Gly
  Variant (3)..(3): Xaa in position 3 is Ile, Leu or Val
  Variant (4)..(4): Xaa in position 4 is Ala or Gly
  Variant (5)..(6): Xaa in position 5 to 6 is any amino acid
  Variant (8)..(8): Xaa in position 8 is Ala, Gly or Ser
  Variant (10)..(11): Xaa in position 10 to 11 is any amino acid
  Variant (12)..(12): Xaa in position 12 is any or no amino acid
PXXXXXYXGXXXR

SEQ ID NO: 12354 - protein, 20 aa, Artificial sequence
  protein pattern
  Variant (2)..(3): Xaa in position 2 to 3 is any amino acid
  Variant (5)..(5): Xaa in position 5 is Phe or Tyr
  Variant (8)..(8): Xaa in position 8 is any or no amino acid
  Variant (10)..(10): Xaa in position 10 is any amino acid
  Variant (11)..(11): Xaa in position 11 is any or no amino acid
  Variant (13)..(13): Xaa in position 13 is Glu or His
  Variant (14)..(15): Xaa in position 14 to 15 is any amino acid
  Variant (16)..(16): Xaa in position 16 is Ala, Gly or Ser
  Variant (17)..(17): Xaa in position 17 is Ala or Gly
  Variant (18)..(18): Xaa in position 18 is any amino acid
  Variant (19)..(19): Xaa in position 19 is Ala, Gly, Ser or Thr
  Variant (20)..(20): Xaa in position 20 is Ala, Gly or Ser
GXXDXAGXGXXVXXXXXXXX

SEQ ID NO: 12355 - protein, 16 aa, Artificial sequence
  protein pattern
  Variant (3)..(3): Xaa in position 3 is any amino acid
  Variant (4)..(4): Xaa in position 4 is Ala, Ile, Leu or Val
  Variant (5)..(5): Xaa in position 5 is Ala, Ser or Thr
  Variant (6)..(6): Xaa in position 6 is any amino acid
  Variant (7)..(7): Xaa in position 7 is Ala, Gly, Ile, Pro or Val
  Variant (8)..(8): Xaa in position 8 is Ile or Leu
  Variant (9)..(10): Xaa in position 9 to 10 is any amino acid
  Variant (11)..(11): Xaa in position 11 is Gly or Ser
  Variant (12)..(12): Xaa in position 12 is Ala, Cys, Gly or Ser
  Variant (13)..(14): Xaa in position 13 to 14 is any amino acid
  Variant (15)..(15): Xaa in position 15 is Ala, Asp, Glu or Gly
FAXXXXXXXXXXXXXR

SEQ ID NO: 12356 - protein, 33 aa, Artificial sequence; identical to SEQ ID NO: 2064
  protein pattern
  Variant (2)..(3): Xaa in position 2 to 3 is any amino acid
  Variant (4)..(4): Xaa in position 4 is any or no amino acid
  Variant (6)..(7): Xaa in position 6 to 7 is any amino acid
  Variant (8)..(8): Xaa in position 8 is any or no amino acid
  Variant (11)..(11): Xaa in position 11 is Gly or Val
  Variant (12)..(12): Xaa in position 12 is Ala, Cys, Gly, Ser, Thr or Val
  Variant (13)..(13): Xaa in position 13 is Ala, Ile, Leu or Val
  Variant (14)..(14): Xaa in position 14 is Ser or Thr
  Variant (16)..(17): Xaa in position 16 to 17 is Ala, Cys, Gly or Ser
  Variant (19)..(24): Xaa in position 19 to 24 is any amino acid
  Variant (25)..(25): Xaa in position 25 is Ala, Gly or Ser
  Variant (26)..(28): Xaa in position 26 to 28 is any amino acid
  Variant (29)..(29): Xaa in position 29 is Ala or Gly
  Variant (30)..(32): Xaa in position 30 to 32 is any amino acid
  Variant (33)..(33): Xaa in position 33 is Ala, Gly or Ser

SEQ ID NO: 12357 - DNA, 1263 bp, Saccharomyces cerevisiae
  CDS (1)..(1263)
atgtctaagggaaaagtttgtttggcttattctggtggtttagatacctccgtcattttggcttggctactagaccaaggctacgaagttgtagctttcatggctaatgtagggcaagaagaagatttcgatgccgccaaggaaaaggccttgaagatcggtgcctgcaagttcgtttgtgtggattgtcgtgaagattttgtcaaggatattctattcccagctgtacaggtcaacgctgtgtacgaagacgtttatctgttgggtacctctttggcaagacctgttattgccaaagcccaaattgacgtcgctaaacaggagggctgtttcgcggtctctcatggttgtaccggtaaaggtaatgatcaaatcagattcgaattgtcattttacgctctgaagccagacgttaagtgtattacaccatggagaatgcctgaatttttcgaaagatttgctggcagaaaggatttgttagactatgctgcacaaaagggtattcccgtcgcccaaaccaaggccaagccatggtctactgacgaaaaccaagcccacatttcttacgaggcaggtatcttggaagacccagataccaccccaccaaaggacatgtggaaattgatcgtcgatccaatggatgctccggaccaaccacaagatttgaccattgactttgaacgtggtcttccagtcaagttgacctacaccgacaacaagacttccaaggaagtttccgttaccaagcctttggatgttttcttggccgcatccaacttagcaagggccaacggtgttggtagaatcgatattgtagaagatcgttacattaacttgaaatccagaggttgttacgaacaggctccattgactgttttgagaaaagctcatgttgatttggaaggtttgactttagacaaagaagtccgtcaattgagagactcattcgtcacaccaaactactccagattgatatataacggttcctacttcaccccagagtgtgagtacatcagatctatgatccaaccatcccaaaatagcgttaacggtactgtcagggttagactgtataagggtaacgtcatcattctgggcagatctacaaagactgaaaagttgtacgatccgacagaatcctctatggatgagttgaccggtttcttacctaccgataccaccggtttcattgccatccaggccattagaattaaaaaatacggtgaatccaaaaaaaccaaaggtgaagagttgactttgtaa

SEQ ID NO: 12358 - protein, 420 aa, Saccharomyces cerevisiae
MSKGKVCLAYSGGLDTSVILAWLLDQGYEVVAFMANVGQEEDFDAAKEKALKIGACKFVCVDCREDFVKDILFPAVQVNAVYEDVYLLGTSLARPVIAKAQIDVAKQEGCFAVSHGCTGKGNDQIRFELSFYALKPDVKCITPWRMPEFFERFAGRKDLLDYAAQKGIPVAQTKAKPWSTDENQAHISYEAGILEDPDTTPPKDMWKLIVDPMDAPDQPQDLTIDFERGLPVKLTYTDNKTSKEVSVTKPLDVFLAASNLARANGVGRIDIVEDRYINLKSRGCYEQAPLTVLRKAHVDLEGLTLDKEVRQLRDSFVTPNYSRLIYNGSYFTPECEYIRSMIQPSQNSVNGTVRVRLYKGNVIILGRSTKTEKLYDPTESSMDELTGFLPTDTTGFIAIQAIRIKKYGESKKTKGEELTL

SEQ ID NO: 12359 - DNA, 1245 bp, Ashbya gossypii; identical to SEQ ID NO: 5161
  CDS (1)..(1245)

SEQ ID NO: 12360 - protein, 414 aa, Ashbya gossypii; identical to SEQ ID NO: 5162

SEQ ID NO: 12361 - DNA, 1227 bp, Neurospora crassa; identical to SEQ ID NO: 5163
  CDS (1)..(1227)

SEQ ID NO: 12362 - protein, 408 aa, Neurospora crassa; identical to SEQ ID NO: 5164

SEQ ID NO: 12363 - DNA, 1413 bp, Kineococcus radiotolerans SRS30216; identical to SEQ ID NO: 5165
  CDS (1)..(1413): transl_table=11

SEQ ID NO: 12364 - protein, 470 aa, Kineococcus radiotolerans SRS30216; identical to SEQ ID NO: 5166

SEQ ID NO: 12365 - DNA, 1194 bp, Lactococcus lactis subsp. lactis Il1403; identical to SEQ ID NO: 5167
  CDS (1)..(1194): transl_table=11

SEQ ID NO: 12366 - protein, 397 aa, Lactococcus lactis subsp. lactis Il1403; identical to SEQ ID NO: 5168

SEQ ID NO: 12367 - DNA, 1221 bp, Sulfolobus solfataricus P2; identical to SEQ ID NO: 5169
  CDS (1)..(1221): transl_table=11

SEQ ID NO: 12368 - protein, 406 aa, Sulfolobus solfataricus P2; identical to SEQ ID NO: 5170

SEQ ID NO: 12369 - DNA, 1383 bp, Agrobacterium tumefaciens str. C58; identical to SEQ ID NO: 5171
  CDS (1)..(1383): transl_table=11

SEQ ID NO: 12370 - protein, 460 aa, Agrobacterium tumefaciens str. C58; identical to SEQ ID NO: 5172

SEQ ID NO: 12371 - DNA, 1248 bp, Streptococcus pneumoniae R6; identical to SEQ ID NO: 5173
  CDS (1)..(1248): transl_table=11

SEQ ID NO: 12372 - protein, 415 aa, Streptococcus pneumoniae R6; identical to SEQ ID NO: 5174

SEQ ID NO: 12373 - DNA, 1218 bp, Thermoplasma acidophilum DSM 1728; identical to SEQ ID NO: 5175
  CDS (1)..(1218): transl_table=11

SEQ ID NO: 12374 - protein, 405 aa, Thermoplasma acidophilum DSM 1728; identical to SEQ ID NO: 5176

SEQ ID NO: 12375 - DNA, 1245 bp, Methanosarcina mazei Go1; identical to SEQ ID NO: 5177
  CDS (1)..(1245): transl_table=11

SEQ ID NO: 12376 - protein, 414 aa, Methanosarcina mazei Go1; identical to SEQ ID NO: 5178

SEQ ID NO: 12377 - DNA, 1371 bp, Yersinia pestis KIM; identical to SEQ ID NO: 5179
  CDS (1)..(1371): transl_table=11

SEQ ID NO: 12378 - protein, 456 aa, Yersinia pestis KIM; identical to SEQ ID NO: 5180

SEQ ID NO: 12379 - DNA, 1218 bp, Vibrio vulnificus CMCP6; identical to SEQ ID NO: 5181
  CDS (1)..(1218): transl_table=11

SEQ ID NO: 12380 - protein, 405 aa, Vibrio vulnificus CMCP6; identical to SEQ ID NO: 5182

SEQ ID NO: 12381 - DNA, 1410 bp, Salmonella enterica subsp. enterica serovar Typhi Ty2; identical to SEQ ID NO: 5183
  CDS (1)..(1410): transl_table=11

SEQ ID NO: 12382 - protein, 469 aa, Salmonella enterica subsp. enterica serovar Typhi Ty2; identical to SEQ ID NO: 5184

SEQ ID NO: 12383 - DNA, 1209 bp, Bacteroides thetaiotaomicron VPI-5482; identical to SEQ ID NO: 5185
  CDS (1)..(1209): transl_table=11

SEQ ID NO: 12384 - protein, 402 aa, Bacteroides thetaiotaomicron VPI-5482; identical to SEQ ID NO: 5186

SEQ ID NO: 12385 - DNA, 1455 bp, Streptomyces avermitilis MA-4680; identical to SEQ ID NO: 5187
  CDS (1)..(1455): transl_table=11

SEQ ID NO: 12386 - protein, 484 aa, Streptomyces avermitilis MA-4680; identical to SEQ ID NO: 5188

SEQ ID NO: 12387 - DNA, 1335 bp, Rhodopirellula baltica SH 1; identical to SEQ ID NO: 5189
  CDS (1)..(1335): transl_table=11

SEQ ID NO: 12388 - protein, 444 aa, Rhodopirellula baltica SH 1; identical to SEQ ID NO: 5190

SEQ ID NO: 12389 - DNA, 1332 bp, Haemophilus ducreyi 35000HP; identical to SEQ ID NO: 5191
  CDS (1)..(1332): transl_table=11

SEQ ID NO: 12390 - protein, 443 aa, Haemophilus ducreyi 35000HP; identical to SEQ ID NO: 5192

SEQ ID NO: 12391 - DNA, 1191 bp, Photorhabdus luminescens subsp. laumondii TTO1; identical to SEQ ID NO: 5193
  CDS (1)..(1191): transl_table=11

SEQ ID NO: 12392 - protein, 396 aa, Photorhabdus luminescens subsp. laumondii TTO1; identical to SEQ ID NO: 5194

SEQ ID NO: 12393 - DNA, 1257 bp, Vibrio vulnificus YJ016; identical to SEQ ID NO: 5195
  CDS (1)..(1257): transl_table=11

SEQ ID NO: 12394 - protein, 418 aa, Vibrio vulnificus YJ016; identical to SEQ ID NO: 5196

SEQ ID NO: 12395 - DNA, 1338 bp, Rhodopseudomonas palustris CGA009; identical to SEQ ID NO: 5197
  CDS (1)..(1338): transl_table=11

SEQ ID NO: 12396 - protein, 445 aa, Rhodopseudomonas palustris CGA009; identical to SEQ ID NO: 5198

SEQ ID NO: 12397 - DNA, 1248 bp, Magnaporthe grisea 70-15; identical to SEQ ID NO: 5199
  CDS (1)..(1248)

SEQ ID NO: 12398 - protein, 415 aa, Magnaporthe grisea 70-15; identical to SEQ ID NO: 5200

SEQ ID NO: 12399 - DNA, 1248 bp, Magnaporthe grisea 70-15; identical to SEQ ID NO: 5201
  CDS (1)..(1248)

SEQ ID NO: 12400 - protein, 415 aa, Magnaporthe grisea 70-15; identical to SEQ ID NO: 5202

SEQ ID NO: 12401 - DNA, 1185 bp, Gibberella zeae PH-1; identical to SEQ ID NO: 5203
  CDS (1)..(1185)

SEQ ID NO: 12402 - protein, 394 aa, Gibberella zeae PH-1; identical to SEQ ID NO: 5204

SEQ ID NO: 12403 - DNA, 1248 bp, Gibberella zeae PH-1; identical to SEQ ID NO: 5205
  CDS (1)..(1248)

SEQ ID NO: 12404 - protein, 415 aa, Gibberella zeae PH-1; identical to SEQ ID NO: 5206

SEQ ID NO: 12405 - DNA, 1263 bp, Candida glabrata CBS 138; identical to SEQ ID NO: 5207
  CDS (1)..(1263)

SEQ ID NO: 12406 - protein, 420 aa, Candida glabrata CBS 138; identical to SEQ ID NO: 5208

SEQ ID NO: 12407 - DNA, 1263 bp, Kluyveromyces lactis NRRL Y-1140; identical to SEQ ID NO: 5209
  CDS (1)..(1263)

SEQ ID NO: 12408 - protein, 420 aa, Kluyveromyces lactis NRRL Y-1140; identical to SEQ ID NO: 5210

SEQ ID NO: 12409 - DNA, 1251 bp, Debaryomyces hansenii CBS767; identical to SEQ ID NO: 5211
  CDS (1)..(1251)

SEQ ID NO: 12410 - protein, 416 aa, Debaryomyces hansenii CBS767; identical to SEQ ID NO: 5212

SEQ ID NO: 12411 - DNA, 1407 bp, Aspergillus nidulans FGSC A4; identical to SEQ ID NO: 5213
  CDS (1)..(1407)

SEQ ID NO: 12412 - protein, 468 aa, Aspergillus nidulans FGSC A4; identical to SEQ ID NO: 5214

SEQ ID NO: 12413 - DNA, 1482 bp, Candida albicans SC5314; identical to SEQ ID NO: 5215
  CDS (1)..(1482): transl_table=12

SEQ ID NO: 12414 - protein, 493 aa, Candida albicans SC5314; identical to SEQ ID NO: 5216

SEQ ID NO: 12415 - DNA, 1281 bp, Ustilago maydis 521; identical to SEQ ID NO: 5217
  CDS (1)..(1281)

SEQ ID NO: 12416 - protein, 426 aa, Ustilago maydis 521; identical to SEQ ID NO: 5218

SEQ ID NO: 12417 - DNA, 1290 bp, Cryptococcus neoformans var. neoformans B-3501A; identical to SEQ ID NO: 5219
  CDS (1)..(1290)

SEQ ID NO: 12418 - protein, 429 aa, Cryptococcus neoformans var. neoformans B-3501A; identical to SEQ ID NO: 5220

SEQ ID NO: 12419 - DNA, 1215 bp, Prochlorococcus marinus str. AS9601; identical to SEQ ID NO: 5221
  CDS (1)..(1215): transl_table=11

SEQ ID NO: 12420 - protein, 404 aa, Prochlorococcus marinus str. AS9601; identical to SEQ ID NO: 5222

SEQ ID NO: 12421 - DNA, 1215 bp, Prochlorococcus marinus str. MIT 9515; identical to SEQ ID NO: 5223
  CDS (1)..(1215): transl_table=11

SEQ ID NO: 12422 - protein, 404 aa, Prochlorococcus marinus str. MIT 9515; identical to SEQ ID NO: 5224

SEQ ID NO: 12423 - DNA, 1203 bp, Prochlorococcus marinus str. NATL1A; identical to SEQ ID NO: 5225
  CDS (1)..(1203): transl_table=11

SEQ ID NO: 12424 - protein, 400 aa, Prochlorococcus marinus str. NATL1A; identical to SEQ ID NO: 5226

SEQ ID NO: 12425 - DNA, 1206 bp, Prochlorococcus marinus str. MIT 9303; identical to SEQ ID NO: 5227
  CDS (1)..(1206): transl_table=11

SEQ ID NO: 12426 - protein, 401 aa, Prochlorococcus marinus str. MIT 9303; identical to SEQ ID NO: 5228

SEQ ID NO: 12427 - DNA, 1218 bp, Clostridium thermocellum ATCC 27405; identical to SEQ ID NO: 5229
  CDS (1)..(1218): transl_table=11

SEQ ID NO: 12428 - protein, 405 aa, Clostridium thermocellum ATCC 27405; identical to SEQ ID NO: 5230

SEQ ID NO: 12429 - DNA, 1203 bp, Mycobacterium sp. JLS; identical to SEQ ID NO: 5231
  CDS (1)..(1203): transl_table=11

SEQ ID NO: 12430 - protein, 400 aa, Mycobacterium sp. JLS; identical to SEQ ID NO: 5232

SEQ ID NO: 12431 - DNA, 1215 bp, Prochlorococcus marinus str. MIT 9301; identical to SEQ ID NO: 5233
  CDS (1)..(1215): transl_table=11

SEQ ID NO: 12432 - protein, 404 aa, Prochlorococcus marinus str. MIT 9301; identical to SEQ ID NO: 5234

SEQ ID NO: 12433 - DNA, 1338 bp, Herminiimonas arsenicoxydans; identical to SEQ ID NO: 5235
  CDS (1)..(1338): transl_table=11

SEQ ID NO: 12434 - protein, 445 aa, Herminiimonas arsenicoxydans; identical to SEQ ID NO: 5236

SEQ ID NO: 12435 - DNA, 1338 bp, Burkholderia vietnamiensis G4; identical to SEQ ID NO: 5237
  CDS (1)..(1338): transl_table=11

SEQ ID NO: 12436 - protein, 445 aa, Burkholderia vietnamiensis G4; identical to SEQ ID NO: 5238

SEQ ID NO: 12437 - DNA, 1347 bp, Bradyrhizobium sp. ORS278; identical to SEQ ID NO: 5239
  CDS (1)..(1347): transl_table=11

SEQ ID NO: 12438 - protein, 448 aa, Bradyrhizobium sp. ORS278; identical to SEQ ID NO: 5240

SEQ ID NO: 12439 - DNA, 1206 bp, Synechococcus sp. WH 7803; identical to SEQ ID NO: 5241
  CDS (1)..(1206): transl_table=11

SEQ ID NO: 12440 - protein, 401 aa, Synechococcus sp. WH 7803; identical to SEQ ID NO: 5242

SEQ ID NO: 12441 - DNA, 1341 bp, Acinetobacter sp. ADP1; identical to SEQ ID NO: 5243
  CDS (1)..(1341): transl_table=11

SEQ ID NO: 12442 - protein, 446 aa, Acinetobacter sp. ADP1; identical to SEQ ID NO: 5244

SEQ ID NO: 12443 - DNA, 1347 bp, Erwinia carotovora subsp. atroseptica SCRI1043; identical to SEQ ID NO: 5245
  CDS (1)..(1347): transl_table=11

SEQ ID NO: 12444 - protein, 448 aa, Erwinia carotovora subsp. atroseptica SCRI1043; identical to SEQ ID NO: 5246

SEQ ID NO: 12445 - DNA, 1425 bp, Propionibacterium acnes KPA171202; identical to SEQ ID NO: 5247
  CDS (1)..(1425): transl_table=11

SEQ ID NO: 12446 - protein, 474 aa, Propionibacterium acnes KPA171202; identical to SEQ ID NO: 5248

SEQ ID NO: 12447 - DNA, 1437 bp, Leifsonia xyli subsp. xyli str. CTCB07; identical to SEQ ID NO: 5249
  CDS (1)..(1437): transl_table=11

SEQ ID NO: 12448 - protein, 478 aa, Leifsonia xyli subsp. xyli str. CTCB07; identical to SEQ ID NO: 5250

SEQ ID NO: 12449 - DNA, 1335 bp, Mannheimia succiniciproducens MBEL55E; identical to SEQ ID NO: 5251
  CDS (1)..(1335): transl_table=11

SEQ ID NO: 12450 - protein, 444 aa, Mannheimia succiniciproducens MBEL55E; identical to SEQ ID NO: 5252

SEQ ID NO: 12451 - DNA, 1344 bp, Neisseria gonorrhoeae FA 1090; identical to SEQ ID NO: 5253
  CDS (1)..(1344): transl_table=11

SEQ ID NO: 12452 - protein, 447 aa, Neisseria gonorrhoeae FA 1090; identical to SEQ ID NO: 5254

SEQ ID NO: 12453 - DNA, 1206 bp, Bacteroides fragilis NCTC 9343; identical to SEQ ID NO: 5255
  CDS (1)..(1206): transl_table=11

SEQ ID NO: 12454 - protein, 401 aa, Bacteroides fragilis NCTC 9343; identical to SEQ ID NO: 5256

SEQ ID NO: 12455 - DNA, 1326 bp, Ralstonia eutropha JMP134; identical to SEQ ID NO: 5257
  CDS (1)..(1326): transl_table=11

SEQ ID NO: 12456 - protein, 441 aa, Ralstonia eutropha JMP134; identical to SEQ ID NO: 5258

SEQ ID NO: 12457 - DNA, 1371 bp, Thiobacillus denitrificans ATCC 25259; identical to SEQ ID NO: 5259
  CDS (1)..(1371): transl_table=11

SEQ ID NO: 12458 - protein, 456 aa, Thiobacillus denitrificans ATCC 25259; identical to SEQ ID NO: 5260

SEQ ID NO: 12459 - DNA, 1335 bp, Burkholderia sp. 383; identical to SEQ ID NO: 5261
  CDS (1)..(1335): transl_table=11

SEQ ID NO: 12460 - protein, 444 aa, Burkholderia sp. 383; identical to SEQ ID NO: 5262

SEQ ID NO: 12461 - DNA, 1260 bp, Rhodospirillum rubrum ATCC 11170; identical to SEQ ID NO: 5263
  CDS (1)..(1260): transl_table=11

SEQ ID NO: 12462 - protein, 419 aa, Rhodospirillum rubrum ATCC 11170; identical to SEQ ID NO: 5264

SEQ ID NO: 12463 - DNA, 1341 bp, Burkholderia thailandensis E264; identical to SEQ ID NO: 5265
  CDS (1)..(1341): transl_table=11

SEQ ID NO: 12464 - protein, 446 aa, Burkholderia thailandensis E264; identical to SEQ ID NO: 5266

SEQ ID NO: 12465 - DNA, 1326 bp, Ralstonia metallidurans CH34; identical to SEQ ID NO: 5267
  CDS (1)..(1326): transl_table=11

SEQ ID NO: 12466 - protein, 441 aa, Ralstonia metallidurans CH34; identical to SEQ ID NO: 5268

SEQ ID NO: 12467 - DNA, 1191 bp, Myxococcus xanthus DK 1622; identical to SEQ ID NO: 5269
  CDS (1)..(1191): transl_table=11

SEQ ID NO: 12468 - protein, 396 aa, Myxococcus xanthus DK 1622; identical to SEQ ID NO: 5270

SEQ ID NO: 12469 - DNA, 1260 bp, Mesorhizobium sp. BNC1; identical to SEQ ID NO: 5271
  CDS (1)..(1260): transl_table=11

SEQ ID NO: 12470 - protein, 419 aa, Mesorhizobium sp. BNC1; identical to SEQ ID NO: 5272

SEQ ID NO: 12471 - DNA, 1335 bp, Haemophilus somnus 129PT; identical to SEQ ID NO: 5273
  CDS (1)..(1335): transl_table=11

SEQ ID NO: 12472 - protein, 444 aa, Haemophilus somnus 129PT; identical to SEQ ID NO: 5274

SEQ ID NO: 12473 - DNA, 1221 bp, Oenococcus oeni PSU-1; identical to SEQ ID NO: 5275
  CDS (1)..(1221): transl_table=11

SEQ ID NO: 12474 - protein, 406 aa, Oenococcus oeni PSU-1; identical to SEQ ID NO: 5276

SEQ ID NO: 12475 - DNA, 1227 bp, Leuconostoc mesenteroides subsp. mesenteroides ATCC 8293; identical to SEQ ID NO: 5277
  CDS (1)..(1227): transl_table=11

SEQ ID NO: 12476 - protein, 408 aa, Leuconostoc mesenteroides subsp. mesenteroides ATCC 8293; identical to SEQ ID NO: 5278

SEQ ID NO: 12477 - DNA, 1362 bp, Solibacter usitatus Ellin6076; identical to SEQ ID NO: 5279
  CDS (1)..(1362): transl_table=11

SEQ ID NO: 12478 - protein, 453 aa, Solibacter usitatus Ellin6076; identical to SEQ ID NO: 5280

SEQ ID NO: 12479 - DNA, 1224 bp, Magnetococcus sp. MC-1; identical to SEQ ID NO: 5281
  CDS (1)..(1224): transl_table=11

SEQ ID NO: 12480 - protein, 407 aa, Magnetococcus sp. MC-1; identical to SEQ ID NO: 5282

SEQ ID NO: 12481 - DNA, 1197 bp, Mycobacterium avium 104; identical to SEQ ID NO: 5283
  CDS (1)..(1197): transl_table=11

SEQ ID NO: 12482 - protein, 398 aa, Mycobacterium avium 104; identical to SEQ ID NO: 5284

SEQ ID NO: 12483 - DNA, 1200 bp, Mycobacterium smegmatis str. MC2 155; identical to SEQ ID NO: 5285
  CDS (1)..(1200): transl_table=11

SEQ ID NO: 12484 - protein, 399 aa, Mycobacterium smegmatis str. MC2 155; identical to SEQ ID NO: 5286

SEQ ID NO: 12485 - DNA, 1434 bp, Nocardioides sp. JS614; identical to SEQ ID NO: 5287
  CDS (1)..(1434): transl_table=11

SEQ ID NO: 12486 - protein, 477 aa, Nocardioides sp. JS614; identical to SEQ ID NO: 5288

SEQ ID NO: 12487 - DNA, 1230 bp, Azoarcus sp. BH72; identical to SEQ ID NO: 5289
  CDS (1)..(1230): transl_table=11

SEQ ID NO: 12488 - protein, 409 aa, Azoarcus sp. BH72; identical to SEQ ID NO: 5290

SEQ ID NO: 12489 - DNA, 1344 bp, Neisseria meningitidis FAM18; identical to SEQ ID NO: 5291
  CDS (1)..(1344): transl_table=11

SEQ ID NO: 12490 - protein, 447 aa, Neisseria meningitidis FAM18; identical to SEQ ID NO: 5292

SEQ ID NO: 12491 - DNA, 1347 bp, Acidovorax sp. JS42; identical to SEQ ID NO: 5293
  CDS (1)..(1347): transl_table=11

SEQ ID NO: 12492 - protein, 448 aa, Acidovorax sp. JS42; identical to SEQ ID NO: 5294

SEQ ID NO: 12493 - DNA, 1473 bp, Magnetospirillum magnetotacticum MS-1; identical to SEQ ID NO: 5295
  CDS (1)..(1473): transl_table=11

SEQ ID NO: 12494 - protein, 490 aa, Magnetospirillum magnetotacticum MS-1; identical to SEQ ID NO: 5296

SEQ ID NO: 12495 - DNA, 1203 bp, Nostoc punctiforme PCC 73102; identical to SEQ ID NO: 5297
  CDS (1)..(1203): transl_table=11

SEQ ID NO: 12496 - protein, 400 aa, Nostoc punctiforme PCC 73102; identical to SEQ ID NO: 5298

SEQ ID NO: 12497 - DNA, 1239 bp, Bifidobacterium longum DJO10A; identical to SEQ ID NO: 5299
  CDS (1)..(1239): transl_table=11

SEQ ID NO: 12498 - protein, 412 aa, Bifidobacterium longum DJO10A; identical to SEQ ID NO: 5300

SEQ ID NO: 12499 - DNA, 1335 bp, Haemophilus somnus 2336; identical to SEQ ID NO: 5301
  CDS (1)..(1335): transl_table=11

SEQ ID NO: 12500 - protein, 444 aa, Haemophilus somnus 2336; identical to SEQ ID NO: 5302

SEQ ID NO: 12501 - DNA, 1335 bp, Haemophilus influenzae R2846; identical to SEQ ID NO: 5303
  CDS (1)..(1335): transl_table=11

SEQ ID NO: 12502 - protein, 444 aa, Haemophilus influenzae R2846; identical to SEQ ID NO: 5304

SEQ ID NO: 12503 - DNA, 1215 bp, Listeria monocytogenes str. 1/2a F6854; identical to SEQ ID NO: 5305
  CDS (1)..(1215): transl_table=11

SEQ ID NO: 12504 - protein, 404 aa, Listeria monocytogenes str. 1/2a F6854; identical to SEQ ID NO: 5306

SEQ ID NO: 12505 - DNA, 1206 bp, Bacillus cereus G9241; identical to SEQ ID NO: 5307
  CDS (1)..(1206): transl_table=11

SEQ ID NO: 12506 - protein, 401 aa, Bacillus cereus G9241; identical to SEQ ID NO: 5308

SEQ ID NO: 12507 - DNA, 1203 bp, Crocosphaera watsonii WH 8501; identical to SEQ ID NO: 5309
  CDS (1)..(1203): transl_table=11

SEQ ID NO: 12508 - protein, 400 aa, Crocosphaera watsonii WH 8501; identical to SEQ ID NO: 5310

SEQ ID NO: 12509 - DNA, 1206 bp, Exiguobacterium sibiricum 255-15; identical to SEQ ID NO: 5311
  CDS (1)..(1206): transl_table=11

SEQ ID NO: 12510 - protein, 401 aa, Exiguobacterium sibiricum 255-15; identical to SEQ ID NO: 5312

SEQ ID NO: 12511 - DNA, 1206 bp, Prosthecochloris aestuarii DSM 271; identical to SEQ ID NO: 5313
  CDS (1)..(1206): transl_table=11

SEQ ID NO: 12512 - protein, 401 aa, Prosthecochloris aestuarii DSM 271; identical to SEQ ID NO: 5314

SEQ ID NO: 12513 - DNA, 1686 bp, Kineococcus radiotolerans SRS30216; identical to SEQ ID NO: 5315
  CDS (1)..(1686): transl_table=11

SEQ ID NO: 12514 - protein, 561 aa, Kineococcus radiotolerans SRS30216; identical to SEQ ID NO: 5316

SEQ ID NO: 12515 - DNA, 1206 bp, Xylella fastidiosa Dixon; identical to SEQ ID NO: 5317
  CDS (1)..(1206): transl_table=11

SEQ ID NO: 12516 - protein, 401 aa, Xylella fastidiosa Dixon; identical to SEQ ID NO: 5318

SEQ ID NO: 12517 - DNA, 1206 bp, Xylella fastidiosa Ann-1; identical to SEQ ID NO: 5319
  CDS (1)..(1206): transl_table=11

SEQ ID NO: 12518 - protein, 401 aa, Xylella fastidiosa Ann-1; identical to SEQ ID NO: 5320

SEQ ID NO: 12519 - DNA, 1221 bp, Sulfitobacter sp. EE-36; identical to SEQ ID NO: 5321
  CDS (1)..(1221): transl_table=11

SEQ ID NO: 12520 - protein, 406 aa, Sulfitobacter sp. EE-36; identical to SEQ ID NO: 5322

SEQ ID NO: 12521 - DNA, 1227 bp, Roseovarius nubinhibens ISM; identical to SEQ ID NO: 5323
  CDS (1)..(1227): transl_table=11

SEQ ID NO: 12522 - protein, 408 aa, Roseovarius nubinhibens ISM; identical to SEQ ID NO: 5324

SEQ ID NO: 12523 - DNA, 1224 bp, Oceanicola batsensis HTCC2597; identical to SEQ ID NO: 5325
  CDS (1)..(1224): transl_table=11

SEQ ID NO: 12524 - protein, 407 aa, Oceanicola batsensis HTCC2597; identical to SEQ ID NO: 5326

SEQ ID NO: 12525 - DNA, 1203 bp, Prochlorococcus marinus str. MIT 9211; identical to SEQ ID NO: 5327
  CDS (1)..(1203): transl_table=11

SEQ ID NO: 12526 - protein, 400 aa, Prochlorococcus marinus str. MIT 9211; identical to SEQ ID NO: 5328

SEQ ID NO: 12527 - DNA, 1224 bp, Erythrobacter sp. NAP1; identical to SEQ ID NO: 5329
  CDS (1)..(1224): transl_table=11

SEQ ID NO: 12528 - protein, 407 aa, Erythrobacter sp. NAP1; identical to SEQ ID NO: 5330

SEQ ID NO: 12529 - DNA, 1206 bp, Synechococcus sp. RS9917; identical to SEQ ID NO: 5331
  CDS (1)..(1206): transl_table=11

SEQ ID NO: 12530 - protein, 401 aa, Synechococcus sp. RS9917; identical to SEQ ID NO: 5332

SEQ ID NO: 12531 - DNA, 1224 bp, Synechococcus sp. WH 5701; identical to SEQ ID NO: 5333
  CDS (1)..(1224): transl_table=11

SEQ ID NO: 12532 - protein, 407 aa, Synechococcus sp. WH 5701; identical to SEQ ID NO: 5334

SEQ ID NO: 12533 - DNA, 1206 bp, Synechococcus sp. WH 7805; identical to SEQ ID NO: 5335
  CDS (1)..(1206): transl_table=11

SEQ ID NO: 12534 - protein, 401 aa, Synechococcus sp. WH 7805; identical to SEQ ID NO: 5336

SEQ ID NO: 12535 - DNA, 1209 bp, Pseudoalteromonas tunicata D2; identical to SEQ ID NO: 5337
  CDS (1)..(1209): transl_table=11

SEQ ID NO: 12536 - protein, 402 aa, Pseudoalteromonas tunicata D2; identical to SEQ ID NO: 5338

SEQ ID NO: 12537 - DNA, 1209 bp, Photobacterium sp. SKA34; identical to SEQ ID NO: 5339
  CDS (1)..(1209): transl_table=11

SEQ ID NO: 12538 - protein, 402 aa, Photobacterium sp. SKA34; identical to SEQ ID NO: 5340

SEQ ID NO: 12539 - DNA, 1227 bp, Oceanospirillum sp. MED92; identical to SEQ ID NO: 5341
  CDS (1)..(1227): transl_table=11

SEQ ID NO: 12540 - protein, 408 aa, Oceanospirillum sp. MED92; identical to SEQ ID NO: 5342

SEQ ID NO: 12541 - DNA, 1230 bp, Xanthobacter autotrophicus Py2; identical to SEQ ID NO: 5343
  CDS (1)..(1230): transl_table=11

SEQ ID NO: 12542 - protein, 409 aa, Xanthobacter autotrophicus Py2; identical to SEQ ID NO: 5344

SEQ ID NO: 12543 - DNA, 1197 bp, Flavobacteria bacterium BBFL7; identical to SEQ ID NO: 5345
  CDS (1)..(1197): transl_table=11

SEQ ID NO: 12544 - protein, 398 aa, Flavobacteria bacterium BBFL7; identical to SEQ ID NO: 5346

SEQ ID NO: 12545 - DNA, 1218 bp, gamma proteobacterium HTCC2207; identical to SEQ ID NO: 5347
  CDS (1)..(1218): transl_table=11

SEQ ID NO: 12546 - protein, 405 aa, gamma proteobacterium HTCC2207; identical to SEQ ID NO: 5348

SEQ ID NO: 12547 - DNA, 1212 bp, delta proteobacterium MLMS-1; identical to SEQ ID NO: 5349
  CDS (1)..(1212): transl_table=11

SEQ ID NO: 12548 - protein, 403 aa, delta proteobacterium MLMS-1; identical to SEQ ID NO: 5350

SEQ ID NO: 12549 - DNA, 1218 bp, Oceanobacter sp. RED65; identical to SEQ ID NO: 5351
  CDS (1)..(1218): transl_table=11

SEQ ID NO: 12550 - protein, 405 aa, Oceanobacter sp. RED65; identical to SEQ ID NO: 5352

SEQ ID NO: 12551 - DNA, 1206 bp, Desulfitobacterium hafniense DCB-2; identical to SEQ ID NO: 5353
  CDS (1)..(1206): transl_table=11

SEQ ID NO: 12552 - protein, 401 aa, Desulfitobacterium hafniense DCB-2; identical to SEQ ID NO: 5354

SEQ ID NO: 12553 - DNA, 1206 bp, Synechococcus sp. RS9916; identical to SEQ ID NO: 5355
  CDS (1)..(1206): transl_table=11

SEQ ID NO: 12554 - protein, 401 aa, Synechococcus sp. RS9916; identical to SEQ ID NO: 5356

SEQ ID NO: 12555 - DNA, 1215 bp, Vibrio sp. Ex25; identical to SEQ ID NO: 5357
  CDS (1)..(1215): transl_table=11

SEQ ID NO: 12556 - protein, 404 aa, Vibrio sp. Ex25; identical to SEQ ID NO: 5358

SEQ ID NO: 12557 - DNA, 1203 bp, Alteromonadales bacterium TW-7; identical to SEQ ID NO: 5359
  CDS (1)..(1203): transl_table=11

SEQ ID NO: 12558 - protein, 400 aa, Alteromonadales bacterium TW-7; identical to SEQ ID NO: 5360

SEQ ID NO: 12559 - DNA, 1221 bp, marine gamma proteobacterium HTCC2143; identical to SEQ ID NO: 5361
  CDS (1)..(1221): transl_table=11

SEQ ID NO: 12560 - protein, 406 aa, marine gamma proteobacterium HTCC2143; identical to SEQ ID NO: 5362

SEQ ID NO: 12561 - DNA, 1218 bp, marine gamma proteobacterium HTCC2080; identical to SEQ ID NO: 5363
  CDS (1)..(1218): transl_table=11

SEQ ID NO: 12562 - protein, 405 aa, marine gamma proteobacterium HTCC2080; identical to SEQ ID NO: 5364

SEQ ID NO: 12563 - DNA, 1200 bp, Candidatus Desulfococcus oleovorans Hxd3; identical to SEQ ID NO: 5365
  CDS (1)..(1200): transl_table=11

SEQ ID NO: 12564 - protein, 399 aa, Candidatus Desulfococcus oleovorans Hxd3; identical to SEQ ID NO: 5366

SEQ ID NO: 12565 - DNA, 1218 bp, Pseudomonas putida GB-1; identical to SEQ ID NO: 5367
  CDS (1)..(1218): transl_table=11

SEQ ID NO: 12566 - protein, 405 aa, Pseudomonas putida GB-1; identical to SEQ ID NO: 5368

SEQ ID NO: 12567 - DNA, 1212 bp, Marinobacter sp. ELB17; identical to SEQ ID NO: 5369
  CDS (1)..(1212): transl_table=11

SEQ ID NO: 12568 - protein, 403 aa, Marinobacter sp. ELB17; identical to SEQ ID NO: 5370

SEQ ID NO: 12569 - DNA, 1335 bp, Herbaspirillum seropedicae; identical to SEQ ID NO: 5371
  CDS (1)..(1335): transl_table=11

SEQ ID NO: 12570 - protein, 444 aa, Herbaspirillum seropedicae; identical to SEQ ID NO: 5372

SEQ ID NO: 12571 - DNA, 1215 bp, Magnetospirillum gryphiswaldense; identical to SEQ ID NO: 5373
  CDS (1)..(1215): transl_table=11

SEQ ID NO: 12572 - protein, 404 aa, Magnetospirillum gryphiswaldense; identical to SEQ ID NO: 5374

SEQ ID NO: 12573 - DNA, 1356 bp, Ostreococcus tauri; identical to SEQ ID NO: 5375
  CDS (1)..(1356)

SEQ ID NO: 12574 - protein, 451 aa, Ostreococcus tauri; identical to SEQ ID NO: 5376

SEQ ID NO: 12575 - DNA, 1248 bp, Phaeosphaeria nodorum; identical to SEQ ID NO: 5377
  CDS (1)..(1248)

SEQ ID NO: 12576 - protein, 415 aa, Phaeosphaeria nodorum; identical to SEQ ID NO: 5378

SEQ ID NO: 12577 - DNA, 1263 bp, Candidatus Kuenenia stuttgartiensis; identical to SEQ ID NO: 5379
  CDS (1)..(1263): transl_table=11

SEQ ID NO: 12578 - protein, 420 aa, Candidatus Kuenenia stuttgartiensis; identical to SEQ ID NO: 5380

SEQ ID NO: 12579 - DNA, 1398 bp, Medicago truncatula; identical to SEQ ID NO: 5381
  CDS (1)..(1398)

SEQ ID NO: 12580 - protein, 465 aa, Medicago truncatula; identical to SEQ ID NO: 5382

SEQ ID NO: 12581 - DNA, 1254 bp, Aspergillus oryzae; identical to SEQ ID NO: 5383
  CDS (1)..(1254)

SEQ ID NO: 12582 - protein, 417 aa, Aspergillus oryzae; identical to SEQ ID NO: 5384

SEQ ID NO: 12583 - DNA, 1278 bp, Agaricus bisporus; identical to SEQ ID NO: 5385
  CDS (1)..(1278)

SEQ ID NO: 12584 - protein, 425 aa, Agaricus bisporus; identical to SEQ ID NO: 5386

SEQ ID NO: 12585 - DNA, 1194 bp, Streptomyces griseus subsp; identical to SEQ ID NO: 5387
  CDS (1)..(1194): transl_table=11

SEQ ID NO: 12586 - protein, 397 aa, Streptomyces griseus subsp; identical to SEQ ID NO: 5388

SEQ ID NO: 12587 - DNA, 1248 bp, Pichia pastoris; identical to SEQ ID NO: 5389
  CDS (1)..(1248)

SEQ ID NO: 12588 - protein, 415 aa, Pichia pastoris; identical to SEQ ID NO: 5390

SEQ ID NO: 12589 - DNA, 1167 bp, uncultured archaeon GZfos9D1; identical to SEQ ID NO: 5391
  CDS (1)..(1167): transl_table=11

SEQ ID NO: 12590 - protein, 388 aa, uncultured archaeon GZfos9D1; identical to SEQ ID NO: 5392

SEQ ID NO: 12591 - DNA, 1167 bp, uncultured archaeon GZfos26F9; identical to SEQ ID NO: 5393
  CDS (1)..(1167): transl_table=11

SEQ ID NO: 12592 - protein, 388 aa, uncultured archaeon GZfos26F9; identical to SEQ ID NO: 5394

SEQ ID NO: 12593 - DNA, 1212 bp, Rhizobium leguminosarum bv; identical to SEQ ID NO: 5397
  CDS (1)..(1212): transl_table=11

SEQ ID NO: 12594 - protein, 403 aa, Rhizobium leguminosarum bv; identical to SEQ ID NO: 5398

SEQ ID NO: 12595 - DNA, 1224 bp, Rhizobium leguminosarum bv; identical to SEQ ID NO: 5399
  CDS (1)..(1224): transl_table=11

SEQ ID NO: 12596 - protein, 407 aa, Rhizobium leguminosarum bv; identical to SEQ ID NO: 5400

SEQ ID NO: 12597 - DNA, 1218 bp, Acidobacteria bacterium; identical to SEQ ID NO: 5401
  CDS (1)..(1218): transl_table=11

SEQ ID NO: 12598 - protein, 405 aa, Acidobacteria bacterium; identical to SEQ ID NO: 5402

SEQ ID NO: 12599 - DNA, 1224 bp, Agrobacterium tumefaciens; identical to SEQ ID NO: 5403
  CDS (1)..(1224): transl_table=11

SEQ ID NO: 12600 - protein, 407 aa, Agrobacterium tumefaciens; identical to SEQ ID NO: 5404

SEQ ID NO: 12601 - DNA, 1209 bp, Alkalilimnicola ehrlichei; identical to SEQ ID NO: 5405
  CDS (1)..(1209): transl_table=11

SEQ ID NO: 12602 - protein, 402 aa, Alkalilimnicola ehrlichei; identical to SEQ ID NO: 5406

SEQ ID NO: 12603 - DNA, 1203 bp, Anabaena sp; identical to SEQ ID NO: 5407
  CDS (1)..(1203): transl_table=11

SEQ ID NO: 12604 - protein, 400 aa, Anabaena sp; identical to SEQ ID NO: 5408

SEQ ID NO: 12605 - DNA, 1203 bp, Anabaena variabilis; identical to SEQ ID NO: 5409
  CDS (1)..(1203): transl_table=11

SEQ ID NO: 12606 - protein, 400 aa, Anabaena variabilis; identical to SEQ ID NO: 5410

SEQ ID NO: 12607 - DNA, 1206 bp, Aquifex aeolicus; identical to SEQ ID NO: 5411
  CDS (1)..(1206): transl_table=11

SEQ ID NO: 12608 - protein, 401 aa, Aquifex aeolicus; identical to SEQ ID NO: 5412

SEQ ID NO: 12609 - DNA, 1173 bp, Archaeoglobus fulgidus; identical to SEQ ID NO: 5413
  CDS (1)..(1173): transl_table=11

SEQ ID NO: 12610 - protein, 390 aa, Archaeoglobus fulgidus; identical to SEQ ID NO: 5414

SEQ ID NO: 12611 - DNA, 1230 bp, Azoarcus sp; identical to SEQ ID NO: 5415
  CDS (1)..(1230): transl_table=11

SEQ ID NO: 12612 - protein, 409 aa, Azoarcus sp; identical to SEQ ID NO: 5416

SEQ ID NO: 12613 - DNA, 1206 bp, Bacillus anthracis; identical to SEQ ID NO: 5417
  CDS (1)..(1206): transl_table=11

SEQ ID NO: 12614 - protein, 401 aa, Bacillus anthracis; identical to SEQ ID NO: 5418

SEQ ID NO: 12615 - DNA, 1206 bp, Bacillus cereus; identical to SEQ ID NO: 5419
  CDS (1)..(1206): transl_table=11

SEQ ID NO: 12616 - protein, 401 aa, Bacillus cereus; identical to SEQ ID NO: 5420

SEQ ID NO: 12617 - DNA, 1206 bp, Bacillus cereus; identical to SEQ ID NO: 5421
  CDS (1)..(1206): transl_table=11

SEQ ID NO: 12618 - protein, 401 aa, Bacillus cereus; identical to SEQ ID NO: 5422

SEQ ID NO: 12619 - DNA, 1206 bp, Bacillus cereus; identical to SEQ ID NO: 5423
  CDS (1)..(1206): transl_table=11

SEQ ID NO: 12620 - protein, 401 aa, Bacillus cereus; identical to SEQ ID NO: 5424

SEQ ID NO: 12621 - DNA, 1230 bp, Bacillus halodurans; identical to SEQ ID NO: 5425
  CDS (1)..(1230): transl_table=11

SEQ ID NO: 12622 - protein, 409 aa, Bacillus halodurans; identical to SEQ ID NO: 5426

SEQ ID NO: 12623 - DNA, 1206 bp, Bacillus thuringiensis subsp; identical to SEQ ID NO: 5427
  CDS (1)..(1206): transl_table=11

SEQ ID NO: 12624 - protein, 401 aa, Bacillus thuringiensis subsp; identical to SEQ ID NO: 5428

SEQ ID NO: 12625 - DNA, 1212 bp, Bacillus licheniformis; identical to SEQ ID NO: 5429
  CDS (1)..(1212): transl_table=11

SEQ ID NO: 12626 - protein, 403 aa, Bacillus licheniformis; identical to SEQ ID NO: 5430

SEQ ID NO: 12627 - DNA, 1212 bp, Bacillus clausii; identical to SEQ ID NO: 5431
  CDS (1)..(1212): transl_table=11

SEQ ID NO: 12628 - protein, 403 aa, Bacillus clausii; identical to SEQ ID NO: 5432

SEQ ID NO: 12629 - DNA, 1212 bp, Bacillus subtilis; identical to SEQ ID NO: 5433
  CDS (1)..(1212): transl_table=11

SEQ ID NO: 12630 - protein, 403 aa, Bacillus subtilis; identical to SEQ ID NO: 5434

SEQ ID NO: 12631 - DNA, 1239 bp, Bifidobacterium longum; identical to SEQ ID NO: 5435
  CDS (1)..(1239): transl_table=11

SEQ ID NO: 12632 - protein, 412 aa, Bifidobacterium longum; identical to SEQ ID NO: 5436

SEQ ID NO: 12633 - DNA, 1338 bp, Bordetella bronchiseptica; identical to SEQ ID NO: 5437
  CDS (1)..(1338): transl_table=11

SEQ ID NO: 12634 - protein, 445 aa, Bordetella bronchiseptica; identical to SEQ ID NO: 5438

SEQ ID NO: 12635 - DNA, 1338 bp, Bordetella pertussis; identical to SEQ ID NO: 5439
  CDS (1)..(1338): transl_table=11

SEQ ID NO: 12636 - protein, 445 aa, Bordetella pertussis; identical to SEQ ID NO: 5440

SEQ ID NO: 12637 - DNA, 1338 bp, Bradyrhizobium japonicum; identical to SEQ ID NO: 5441
  CDS (1)..(1338): transl_table=11

SEQ ID NO: 12638 - protein, 445 aa, Bradyrhizobium japonicum; identical to SEQ ID NO: 5442

SEQ ID NO: 12639 - DNA, 1221 bp, Brucella suis; identical to SEQ ID NO: 5443
  CDS (1)..(1221): transl_table=11

SEQ ID NO: 12640 - protein, 406 aa, Brucella suis; identical to SEQ ID NO: 5444

SEQ ID NO: 12641 - DNA, 1212 bp, Buchnera aphidicola subsp; identical to SEQ ID NO: 5445
  CDS (1)..(1212): transl_table=11

SEQ ID NO: 12642 - protein, 403 aa, Buchnera aphidicola subsp; identical to SEQ ID NO: 5446

SEQ ID NO: 12643 - DNA, 1206 bp, Buchnera aphidicola subsp; identical to SEQ ID NO: 5447
  CDS (1)..(1206): transl_table=11

SEQ ID NO: 12644 - protein, 401 aa, Buchnera aphidicola subsp; identical to SEQ ID NO: 5448

SEQ ID NO: 12645 - DNA, 1230 bp, Buchnera aphidicola subsp; identical to SEQ ID NO: 5449
  CDS (1)..(1230): transl_table=11

SEQ ID NO: 12646 - protein, 409 aa, Buchnera aphidicola subsp; identical to SEQ ID NO: 5450

SEQ ID NO: 12647 - DNA, 1338 bp, Burkholderia cepacia; identical to SEQ ID NO: 5451
  CDS (1)..(1338): transl_table=11

SEQ ID NO: 12648 - protein, 445 aa, Burkholderia cepacia; identical to SEQ ID NO: 5452

SEQ ID NO: 12649 - DNA, 1215 bp, Burkholderia pseudomallei; identical to SEQ ID NO: 5453
  CDS (1)..(1215): transl_table=11

SEQ ID NO: 12650 - protein, 404 aa, Burkholderia pseudomallei; identical to SEQ ID NO: 5454

SEQ ID NO: 12651 - DNA, 1227 bp, Burkholderia xenovorans; identical to SEQ ID NO: 5455
  CDS (1)..(1227): transl_table=11

SEQ ID NO: 12652 - protein, 408 aa, Burkholderia xenovorans; identical to SEQ ID NO: 5456

SEQ ID NO: 12653 - DNA, 1221 bp, Campylobacter jejuni; identical to SEQ ID NO: 5457
  CDS (1)..(1221): transl_table=11

SEQ ID NO: 12654 - protein, 406 aa, Campylobacter jejuni; identical to SEQ ID NO: 5458

SEQ ID NO: 12655 - DNA, 1221 bp, Campylobacter jejuni; identical to SEQ ID NO: 5459
  CDS (1)..(1221): transl_table=11

SEQ ID NO: 12656 - protein, 406 aa, Campylobacter jejuni; identical to SEQ ID NO: 5460

SEQ ID NO: 12657 - DNA, 1206 bp, Carboxydothermus hydrogenoformans; identical to SEQ ID NO: 5461
  CDS (1)..(1206): transl_table=11

SEQ ID NO: 12658 - protein, 401 aa, Carboxydothermus hydrogenoformans; identical to SEQ ID NO: 5462

SEQ ID NO: 12659 - DNA, 1227 bp, Caulobacter crescentus; identical to SEQ ID NO: 5463
  CDS (1)..(1227): transl_table=11

SEQ ID NO: 12660 - protein, 408 aa, Caulobacter crescentus; identical to SEQ ID NO: 5464

SEQ ID NO: 12661 - DNA, 1206 bp, Chlorobium tepidum; identical to SEQ ID NO: 5465
  CDS (1)..(1206): transl_table=11

SEQ ID NO: 12662 - protein, 401 aa, Chlorobium tepidum; identical to SEQ ID NO: 5466

SEQ ID NO: 12663 - DNA, 1227 bp, Chromobacterium violaceum; identical to SEQ ID NO: 5467
  CDS (1)..(1227): transl_table=11

SEQ ID NO: 12664 - protein, 408 aa, Chromobacterium violaceum; identical to SEQ ID NO: 5468

SEQ ID NO: 12665 - DNA, 1203 bp, Clostridium acetobutylicum; identical to SEQ ID NO: 5469
  CDS (1)..(1203): transl_table=11

SEQ ID NO: 12666 - protein, 400 aa, Clostridium acetobutylicum; identical to SEQ ID NO: 5470

SEQ ID NO: 12667 - DNA, 1200 bp, Clostridium difficile; identical to SEQ ID NO: 5471
  CDS (1)..(1200): transl_table=11

SEQ ID NO: 12668 - protein, 399 aa, Clostridium difficile; identical to SEQ ID NO: 5472

SEQ ID NO: 12669 - DNA, 1212 bp, Clostridium perfringens; identical to SEQ ID NO: 5473
  CDS (1)..(1212): transl_table=11

SEQ ID NO: 12670 - protein, 403 aa, Clostridium perfringens; identical to SEQ ID NO: 5474

SEQ ID NO: 12671 - DNA, 1218 bp, Clostridium perfringens; identical to SEQ ID NO: 5475
  CDS (1)..(1218): transl_table=11

SEQ ID NO: 12672 - protein, 405 aa, Clostridium perfringens; identical to SEQ ID NO: 5476

SEQ ID NO: 12673 - DNA, 1197 bp, Clostridium tetani; identical to SEQ ID NO: 5477
  CDS (1)..(1197): transl_table=11

SEQ ID NO: 12674 - protein, 398 aa, Clostridium tetani; identical to SEQ ID NO: 5478

SEQ ID NO: 12675 - DNA, 1257 bp, Colwellia psychrerythraea; identical to SEQ ID NO: 5479
  CDS (1)..(1257): transl_table=11

SEQ ID NO: 12676 - protein, 418 aa, Colwellia psychrerythraea; identical to SEQ ID NO: 5480

SEQ ID NO: 12677 - DNA, 1200 bp, Corynebacterium diphtheriae; identical to SEQ ID NO: 5481
  CDS (1)..(1200): transl_table=11

SEQ ID NO: 12678 - protein, 399 aa, Corynebacterium diphtheriae; identical to SEQ ID NO: 5482

SEQ ID NO: 12679 - DNA, 1407 bp, Dechloromonas aromatica; identical to SEQ ID NO: 5485
  CDS (1)..(1407): transl_table=11

SEQ ID NO: 12680 - protein, 468 aa, Dechloromonas aromatica; identical to SEQ ID NO: 5486

SEQ ID NO: 12681 - DNA, 1221 bp, Dehalococcoides ethenogenes; identical to SEQ ID NO: 5487
  CDS (1)..(1221): transl_table=11

SEQ ID NO: 12682 - protein, 406 aa, Dehalococcoides ethenogenes; identical to SEQ ID NO: 5488

SEQ ID NO: 12683 - DNA, 1221 bp, Dehalococcoides sp; identical to SEQ ID NO: 5489
  CDS (1)..(1221): transl_table=11

SEQ ID NO: 12684 - protein, 406 aa, Dehalococcoides sp; identical to SEQ ID NO: 5490

SEQ ID NO: 12685 - DNA, 1209 bp, Deinococcus radiodurans; identical to SEQ ID NO: 5491
  CDS (1)..(1209): transl_table=11

SEQ ID NO: 12686 - protein, 402 aa, Deinococcus radiodurans; identical to SEQ ID NO: 5492

SEQ ID NO: 12687 - DNA, 1203 bp, Desulfovibrio desulfuricans; identical to SEQ ID NO: 5493
  CDS (1)..(1203): transl_table=11

SEQ ID NO: 12688 - protein, 400 aa, Desulfovibrio desulfuricans; identical to SEQ ID NO: 5494

SEQ ID NO: 12689 - DNA, 1230 bp, Desulfitobacterium hafniense; identical to SEQ ID NO: 5495
  CDS (1)..(1230): transl_table=11

SEQ ID NO: 12690 - protein, 409 aa, Desulfitobacterium hafniense; identical to SEQ ID NO: 5496

SEQ ID NO: 12691 - DNA, 1197 bp, Desulfotalea psychrophila; identical to SEQ ID NO: 5497
  CDS (1)..(1197): transl_table=11

SEQ ID NO: 12692 - protein, 398 aa, Desulfotalea psychrophila; identical to SEQ ID NO: 5498

SEQ ID NO: 12693 - DNA, 1191 bp, Desulfovibrio vulgaris; identical to SEQ ID NO: 5499
  CDS (1)..(1191): transl_table=11

SEQ ID NO: 12694 - protein, 396 aa, Desulfovibrio vulgaris; identical to SEQ ID NO: 5500

SEQ ID NO: 12695 - DNA, 1344 bp, Escherichia coli O157; identical to SEQ ID NO: 5501
  CDS (1)..(1344): transl_table=11

SEQ ID NO: 12696 - protein, 447 aa, Escherichia coli O157; identical to SEQ ID NO: 5502

SEQ ID NO: 12697 - DNA, 1344 bp, Escherichia coli O6; identical to SEQ ID NO: 5503
  CDS (1)..(1344): transl_table=11

SEQ ID NO: 12698 - protein, 447 aa, Escherichia coli O6; identical to SEQ ID NO: 5504

SEQ ID NO: 12699 - DNA, 1182 bp, Ehrlichia canis; identical to SEQ ID NO: 5505
  CDS (1)..(1182): transl_table=11

SEQ ID NO: 12700 - protein, 393 aa, Ehrlichia canis; identical to SEQ ID NO: 5506

SEQ ID NO: 12701 - DNA, 1182 bp, Ehrlichia chaffeensis; identical to SEQ ID NO: 5507
  CDS (1)..(1182): transl_table=11

SEQ ID NO: 12702 - protein, 393 aa, Ehrlichia chaffeensis; identical to SEQ ID NO: 5508

SEQ ID NO: 12703 - DNA, 1185 bp, Ehrlichia ruminantium; identical to SEQ ID NO: 5509
  CDS (1)..(1185): transl_table=11

SEQ ID NO: 12704 - protein, 394 aa, Ehrlichia ruminantium; identical to SEQ ID NO: 5510

SEQ ID NO: 12705 - DNA, 1203 bp, Frankia sp; identical to SEQ ID NO: 5511
  CDS (1)..(1203): transl_table=11

SEQ ID NO: 12706 - protein, 400 aa, Frankia sp; identical to SEQ ID NO: 5512

SEQ ID NO: 12707 - DNA, 1221 bp, Geobacillus kaustophilus; identical to SEQ ID NO: 5513
  CDS (1)..(1221): transl_table=11

SEQ ID NO: 12708 - protein, 406 aa, Geobacillus kaustophilus; identical to SEQ ID NO: 5514

SEQ ID NO: 12709 - DNA, 1221 bp, Geobacter metallireducens; identical to SEQ ID NO: 5515
  CDS (1)..(1221): transl_table=11

SEQ ID NO: 12710 - protein, 406 aa, Geobacter metallireducens; identical to SEQ ID NO: 5516

SEQ ID NO: 12711 - DNA, 1197 bp, Gloeobacter violaceus; identical to SEQ ID NO: 5519
  CDS (1)..(1197): transl_table=11

SEQ ID NO: 12712 - protein, 398 aa, Gloeobacter violaceus; identical to SEQ ID NO: 5520

SEQ ID NO: 12713 - DNA, 1233 bp, Gluconobacter oxydans; identical to SEQ ID NO: 5521
  CDS (1)..(1233): transl_table=11

SEQ ID NO: 12714 - protein, 410 aa, Gluconobacter oxydans; identical to SEQ ID NO: 5522

SEQ ID NO: 12715 - DNA, 1335 bp, Haemophilus influenzae; identical to SEQ ID NO: 5523
  CDS (1)..(1335): transl_table=11

SEQ ID NO: 12716 - protein, 444 aa, Haemophilus influenzae; identical to SEQ ID NO: 5524

SEQ ID NO: 12717 - DNA, 1263 bp, Haloarcula marismortui; identical to SEQ ID NO: 5525
  CDS (1)..(1263): transl_table=11

SEQ ID NO: 12718 - protein, 420 aa, Haloarcula marismortui; identical to SEQ ID NO: 5526

SEQ ID NO: 12719 - DNA, 1191 bp, Halobacterium salinarium; identical to SEQ ID NO: 5527
  CDS (1)..(1191): transl_table=11

SEQ ID NO: 12720 - protein, 396 aa, Halobacterium salinarium; identical to SEQ ID NO: 5528

SEQ ID NO: 12721 - DNA, 1215 bp, Helicobacter hepaticus; identical to SEQ ID NO: 5529
  CDS (1)..(1215): transl_table=11

SEQ ID NO: 12722 - protein, 404 aa, Helicobacter hepaticus; identical to SEQ ID NO: 5530

SEQ ID NO: 12723 - DNA, 1242 bp, Hyphomonas neptunium; identical to SEQ ID NO: 5531
  CDS (1)..(1242): transl_table=11

SEQ ID NO: 12724 - protein, 413 aa, Hyphomonas neptunium; identical to SEQ ID NO: 5532

SEQ ID NO: 12725 - DNA, 1212 bp, Idiomarina loihiensis; identical to SEQ ID NO: 5533
  CDS (1)..(1212): transl_table=11

SEQ ID NO: 12726 - protein, 403 aa, Idiomarina loihiensis; identical to SEQ ID NO: 5534

SEQ ID NO: 12727 - DNA, 1197 bp, Lactococcus lactis subsp; identical to SEQ ID NO: 5535
  CDS (1)..(1197): transl_table=11

SEQ ID NO: 12728 - protein, 398 aa, Lactococcus lactis subsp; identical to SEQ ID NO: 5536

SEQ ID NO: 12729 - DNA, 1236 bp, Lactobacillus plantarum; identical to SEQ ID NO: 5537
  CDS (1)..(1236): transl_table=11

SEQ ID NO: 12730 - protein, 411 aa, Lactobacillus plantarum; identical to SEQ ID NO: 5538

SEQ ID NO: 12731 - DNA, 1218 bp, Legionella pneumophila subsp; identical to SEQ ID NO: 5539
  CDS (1)..(1218): transl_table=11

SEQ ID NO: 12732 - protein, 405 aa, Legionella pneumophila subsp; identical to SEQ ID NO: 5540

SEQ ID NO: 12733 - DNA, 1212 bp, Leptospira interrogans serogroup Icterohaemorrhagiae serovar; identical to SEQ ID NO: 5541
  CDS (1)..(1212): transl_table=11

SEQ ID NO: 12734 - protein, 403 aa, Leptospira interrogans serogroup Icterohaemorrhagiae serovar; identical to SEQ ID NO: 5542

SEQ ID NO: 12735 - DNA, 1212 bp, Leptospira interrogans; identical to SEQ ID NO: 5543
  CDS (1)..(1212): transl_table=11

SEQ ID NO: 12736 - protein, 403 aa, Leptospira interrogans; identical to SEQ ID NO: 5544

SEQ ID NO: 12737 - DNA, 1215 bp, Listeria innocua; identical to SEQ ID NO: 5545
  CDS (1)..(1215): transl_table=11

SEQ ID NO: 12738 - protein, 404 aa, Listeria innocua; identical to SEQ ID NO: 5546

SEQ ID NO: 12739 - DNA, 1215 bp, Listeria monocytogenes serotype 4b; identical to SEQ ID NO: 5547
  CDS (1)..(1215): transl_table=11

SEQ ID NO: 12740 - protein, 404 aa, Listeria monocytogenes serotype 4b; identical to SEQ ID NO: 5548

SEQ ID NO: 12741 - DNA, 1215 bp, Listeria monocytogenes; identical to SEQ ID NO: 5549
  CDS (1)..(1215): transl_table=11

SEQ ID NO: 12742 - protein, 404 aa, Listeria monocytogenes; identical to SEQ ID NO: 5550

SEQ ID NO: 12743 - DNA, 1185 bp, Methanosarcina acetivorans; identical to SEQ ID NO: 5551
  CDS (1)..(1185): transl_table=11

SEQ ID NO: 12744 - protein, 394 aa, Methanosarcina acetivorans; identical to SEQ ID NO: 5552

SEQ ID NO: 12745 - DNA, 1191 bp, Methanosarcina barkeri; identical to SEQ ID NO: 5553
  CDS (1)..(1191): transl_table=11

SEQ ID NO: 12746 - protein, 396 aa, Methanosarcina barkeri; identical to SEQ ID NO: 5554

SEQ ID NO: 12747 - DNA, 1188 bp, Methanosarcina barkeri; identical to SEQ ID NO: 5555
  CDS (1)..(1188): transl_table=11

SEQ ID NO: 12748 - protein, 395 aa, Methanosarcina barkeri; identical to SEQ ID NO: 5556

SEQ ID NO: 12749 - DNA, 1185 bp, Methanococcoides burtonii; identical to SEQ ID NO: 5557
  CDS (1)..(1185): transl_table=11

SEQ ID NO: 12750 - protein, 394 aa, Methanococcoides burtonii; identical to SEQ ID NO: 5558

SEQ ID NO: 12751 - DNA, 1227 bp, Methylococcus capsulatus; identical to SEQ ID NO: 5559
  CDS (1)..(1227): transl_table=11

SEQ ID NO: 12752 - protein, 408 aa, Methylococcus capsulatus; identical to SEQ ID NO: 5560

SEQ ID NO: 12753 - DNA, 1221 bp, Methylobacillus flagellatus; identical to SEQ ID NO: 5561
  CDS (1)..(1221): transl_table=11

SEQ ID NO: 12754 - protein, 406 aa, Methylobacillus flagellatus; identical to SEQ ID NO: 5562

SEQ ID NO: 12755 - DNA, 1188 bp, Methanococcus jannaschii; identical to SEQ ID NO: 5563
  CDS (1)..(1188): transl_table=11

SEQ ID NO: 12756 - protein, 395 aa, Methanococcus jannaschii; identical to SEQ ID NO: 5564

SEQ ID NO: 12757 - DNA, 1185 bp, Methanopyrus kandleri; identical to SEQ ID NO: 5565
  CDS (1)..(1185): transl_table=11

SEQ ID NO: 12758 - protein, 394 aa, Methanopyrus kandleri; identical to SEQ ID NO: 5566

SEQ ID NO: 12759 - DNA, 1194 bp, Methanococcus maripaludis; identical to SEQ ID NO: 5567
  CDS (1)..(1194): transl_table=11

SEQ ID NO: 12760 - protein, 397 aa, Methanococcus maripaludis; identical to SEQ ID NO: 5568

SEQ ID NO: 12761 - DNA, 1200 bp, Methanobacterium thermoautotrophicum; identical to SEQ ID NO: 5569
  CDS (1)..(1200): transl_table=11

SEQ ID NO: 12762 - protein, 399 aa, Methanobacterium thermoautotrophicum; identical to SEQ ID NO: 5570

SEQ ID NO: 12763 - DNA, 1194 bp, Methanococcus vannielii; identical to SEQ ID NO: 5571
  CDS (1)..(1194): transl_table=11

SEQ ID NO: 12764 - protein, 397 aa, Methanococcus vannielii; identical to SEQ ID NO: 5572

SEQ ID NO: 12765 - DNA, 1227 bp, Moorella thermoacetica; identical to SEQ ID NO: 5573
  CDS (1)..(1227): transl_table=11

SEQ ID NO: 12766 - protein, 408 aa, Moorella thermoacetica; identical to SEQ ID NO: 5574

SEQ ID NO: 12767 - DNA, 1215 bp, Moritella abyssi; identical to SEQ ID NO: 5575
  CDS (1)..(1215): transl_table=11

SEQ ID NO: 12768 - protein, 404 aa, Moritella abyssi; identical to SEQ ID NO: 5576

SEQ ID NO: 12769 - DNA, 1215 bp, Moritella profunda; identical to SEQ ID NO: 5577
  CDS (1)..(1215): transl_table=11

SEQ ID NO: 12770 - protein, 404 aa, Moritella profunda; identical to SEQ ID NO: 5578

SEQ ID NO: 12771 - DNA, 1197 bp, Mycobacterium bovis; identical to SEQ ID NO: 5579
  CDS (1)..(1197): transl_table=11

SEQ ID NO: 12772 - protein, 398 aa, Mycobacterium bovis; identical to SEQ ID NO: 5580

SEQ ID NO: 12773 - DNA, 1200 bp, Mycobacterium leprae; identical to SEQ ID NO: 5581
  CDS (1)..(1200): transl_table=11

SEQ ID NO: 12774 - protein, 399 aa, Mycobacterium leprae; identical to SEQ ID NO: 5582

SEQ ID NO: 12775 - DNA, 1197 bp, Mycobacterium paratuberculosis; identical to SEQ ID NO: 5583
  CDS (1)..(1197): transl_table=11

SEQ ID NO: 12776 - protein, 398 aa, Mycobacterium paratuberculosis; identical to SEQ ID NO: 5584

SEQ ID NO: 12777 - DNA, 1203 bp, Mycobacterium sp; identical to SEQ ID NO: 5585
  CDS (1)..(1203): transl_table=11

SEQ ID NO: 12778 - protein, 400 aa, Mycobacterium sp; identical to SEQ ID NO: 5586

SEQ ID NO: 12779 - DNA, 1344 bp, Neisseria meningitidis serogroup A; identical to SEQ ID NO: 5587
  CDS (1)..(1344): transl_table=11

SEQ ID NO: 12780 - protein, 447 aa, Neisseria meningitidis serogroup A; identical to SEQ ID NO: 5588

SEQ ID NO: 12781 - DNA, 1344 bp, Neisseria meningitidis serogroup B; identical to SEQ ID NO: 5589
  CDS (1)..(1344): transl_table=11

SEQ ID NO: 12782 - protein, 447 aa, Neisseria meningitidis serogroup B; identical to SEQ ID NO: 5590

SEQ ID NO: 12783 - DNA, 1215 bp, Nitrosomonas europaea; identical to SEQ ID NO: 5591
  CDS (1)..(1215): transl_table=11

SEQ ID NO: 12784 - protein, 404 aa, Nitrosomonas europaea; identical to SEQ ID NO: 5592

SEQ ID NO: 12785 - DNA, 1203 bp, Nocardia farcinica; identical to SEQ ID NO: 5593
  CDS (1)..(1203): transl_table=11

SEQ ID NO: 12786 - protein, 400 aa, Nocardia farcinica; identical to SEQ ID NO: 5594

SEQ ID NO: 12787 - DNA, 1215 bp, Novosphingobium aromaticivorans; identical to SEQ ID NO: 5595
  CDS (1)..(1215): transl_table=11

SEQ ID NO: 12788 - protein, 404 aa, Novosphingobium aromaticivorans; identical to SEQ ID NO: 5596

SEQ ID NO: 12789 - DNA, 1254 bp, Oceanobacillus iheyensis; identical to SEQ ID NO: 5597
  CDS (1)..(1254): transl_table=11

SEQ ID NO: 12790 - protein, 417 aa, Oceanobacillus iheyensis; identical to SEQ ID NO: 5598

SEQ ID NO: 12791 - DNA, 1338 bp, Pasteurella multocida; identical to SEQ ID NO: 5599
  CDS (1)..(1338): transl_table=11

SEQ ID NO: 12792 - protein, 445 aa, Pasteurella multocida; identical to SEQ ID NO: 5600

SEQ ID NO: 12793 - DNA, 1215 bp, Photorhabdus luminescens subsp; identical to SEQ ID NO: 5601
  CDS (1)..(1215): transl_table=11

SEQ ID NO: 12794 - protein, 404 aa, Photorhabdus luminescens subsp; identical to SEQ ID NO: 5602

SEQ ID NO: 12795 - DNA, 1215 bp, Photobacterium profundum; identical to SEQ ID NO: 5603
  CDS (1)..(1215): transl_table=11

SEQ ID NO: 12796 - protein, 404 aa, Photobacterium profundum; identical to SEQ ID NO: 5604

SEQ ID NO: 12797 - DNA, 1188 bp, Picrophilus torridus; identical to SEQ ID NO: 5605
  CDS (1)..(1188): transl_table=11

SEQ ID NO: 12798 - protein, 395 aa, Picrophilus torridus; identical to SEQ ID NO: 5606

SEQ ID NO: 12799 - DNA, 1215 bp, Prochlorococcus marinus; identical to SEQ ID NO: 5607
  CDS (1)..(1215): transl_table=11

SEQ ID NO: 12800 - protein, 404 aa, Prochlorococcus marinus; identical to SEQ ID NO: 5608

SEQ ID NO: 12801 - DNA, 1209 bp, Prochlorococcus marinus; identical to SEQ ID NO: 5609
  CDS (1)..(1209): transl_table=11

SEQ ID NO: 12802 - protein, 402 aa, Prochlorococcus marinus; identical to SEQ ID NO: 5610

SEQ ID NO: 12803 - DNA, 1206 bp, Prochlorococcus marinus; identical to SEQ ID NO: 5611
  CDS (1)..(1206): transl_table=11

SEQ ID NO: 12804 - protein, 401 aa, Prochlorococcus marinus; identical to SEQ ID NO: 5612

SEQ ID NO: 12805 - DNA, 1215 bp, Prochlorococcus marinus subsp; identical to SEQ ID NO: 5613
  CDS (1)..(1215): transl_table=11

SEQ ID NO: 12806 - protein, 404 aa, Prochlorococcus marinus subsp; identical to SEQ ID NO: 5614

SEQ ID NO: 12807 - DNA, 1203 bp, Prochlorococcus marinus; identical to SEQ ID NO: 5615
  CDS (1)..(1203): transl_table=11

SEQ ID NO: 12808 - protein, 400 aa, Prochlorococcus marinus; identical to SEQ ID NO: 5616

SEQ ID NO: 12809 - DNA, 1218 bp, Pseudomonas syringae pv; identical to SEQ ID NO: 5617
  CDS (1)..(1218): transl_table=11

SEQ ID NO: 12810 - protein, 405 aa, Pseudomonas syringae pv; identical to SEQ ID NO: 5618

SEQ ID NO: 12811 - DNA, 1218 bp, Pseudomonas aeruginosa; identical to SEQ ID NO: 5619
  CDS (1)..(1218): transl_table=11

SEQ ID NO: 12812 - protein, 405 aa, Pseudomonas aeruginosa; identical to SEQ ID NO: 5620

SEQ ID NO: 12813 - DNA, 1218 bp, Pseudomonas fluorescens; identical to SEQ ID NO: 5621
  CDS (1)..(1218): transl_table=11

SEQ ID NO: 12814 - protein, 405 aa, Pseudomonas fluorescens; identical to SEQ ID NO: 5622

SEQ ID NO: 12815 - DNA, 1218 bp, Pseudomonas fluorescens; identical to SEQ ID NO: 5623
  CDS (1)..(1218): transl_table=11

SEQ ID NO: 12816 - protein, 405 aa, Pseudomonas fluorescens; identical to SEQ ID NO: 5624

SEQ ID NO: 12817 - DNA, 1218 bp, Pseudomonas putida; identical to SEQ ID NO: 5625
  CDS (1)..(1218): transl_table=11

SEQ ID NO: 12818 - protein, 405 aa, Pseudomonas putida; identical to SEQ ID NO: 5626

SEQ ID NO: 12819 - DNA, 1218 bp, Pseudomonas syringae pv; identical to SEQ ID NO: 5627
  CDS (1)..(1218): transl_table=11

SEQ ID NO: 12820 - protein, 405 aa, Pseudomonas syringae pv; identical to SEQ ID NO: 5628

SEQ ID NO: 12821 - DNA, 1218 bp, Pseudomonas syringae pv; identical to SEQ ID NO: 5629
  CDS (1)..(1218): transl_table=11

SEQ ID NO: 12822 - protein, 405 aa, Pseudomonas syringae pv; identical to SEQ ID NO: 5630

SEQ ID NO: 12823 - DNA, 1233 bp, Pyrococcus furiosus; identical to SEQ ID NO: 5631
  CDS (1)..(1233): transl_table=11

SEQ ID NO: 12824 - protein, 410 aa, Pyrococcus furiosus; identical to SEQ ID NO: 5632

SEQ ID NO: 12825 - DNA, 1338 bp, Ralstonia solanacearum; identical to SEQ ID NO: 5633
  CDS (1)..(1338): transl_table=11

SEQ ID NO: 12826 - protein, 445 aa, Ralstonia solanacearum; identical to SEQ ID NO: 5634

SEQ ID NO: 12827 - DNA, 1224 bp, Rhizobium loti; identical to SEQ ID NO: 5635
  CDS (1)..(1224): transl_table=11

SEQ ID NO: 12828 - protein, 407 aa, Rhizobium loti; identical to SEQ ID NO: 5636

SEQ ID NO: 12829 - DNA, 1218 bp, Rhizobium meliloti; identical to SEQ ID NO: 5637
  CDS (1)..(1218): transl_table=11

SEQ ID NO: 12830 - protein, 405 aa, Rhizobium meliloti; identical to SEQ ID NO: 5638

SEQ ID NO: 12831 - DNA, 1188 bp, Rhodococcus fascians; identical to SEQ ID NO: 5641
  CDS (1)..(1188): transl_table=11

SEQ ID NO: 12832 - protein, 395 aa, Rhodococcus fascians; identical to SEQ ID NO: 5642

SEQ ID NO: 12833 - DNA, 1227 bp, Rhodobacter sphaeroides; identical to SEQ ID NO: 5643
  CDS (1)..(1227): transl_table=11

SEQ ID NO: 12834 - protein, 408 aa, Rhodobacter sphaeroides; identical to SEQ ID NO: 5644

SEQ ID NO: 12835 - DNA, 1200 bp, Rhodococcus sp; identical to SEQ ID NO: 5645
  CDS (1)..(1200): transl_table=11

SEQ ID NO: 12836 - protein, 399 aa, Rhodococcus sp; identical to SEQ ID NO: 5646

SEQ ID NO: 12837 - DNA, 1230 bp, Rubrobacter xylanophilus; identical to SEQ ID NO: 5647
  CDS (1)..(1230): transl_table=11

SEQ ID NO: 12838 - protein, 409 aa, Rubrobacter xylanophilus; identical to SEQ ID NO: 5648

SEQ ID NO: 12839 - DNA, 1230 bp, Saccharophagus degradans; identical to SEQ ID NO: 5649
  CDS (1)..(1230): transl_table=11

SEQ ID NO: 12840 - protein, 409 aa, Saccharophagus degradans; identical to SEQ ID NO: 5650

SEQ ID NO: 12841 - DNA, 1410 bp, Salmonella typhimurium; identical to SEQ ID NO: 5651
  CDS (67)..(1410): transl_table=11

SEQ ID NO: 12842 - protein, 447 aa, Salmonella typhimurium; identical to SEQ ID NO: 5652

SEQ ID NO: 12843 - DNA, 1233 bp, Schizosaccharomyces pombe; identical to SEQ ID NO: 5653
  CDS (1)..(1233)

SEQ ID NO: 12844 - protein, 410 aa, Schizosaccharomyces pombe; identical to SEQ ID NO: 5654

SEQ ID NO: 12845 - DNA, 1224 bp, Shewanella oneidensis; identical to SEQ ID NO: 5655
  CDS (1)..(1224): transl_table=11

SEQ ID NO: 12846 - protein, 407 aa, Shewanella oneidensis; identical to SEQ ID NO: 5656

SEQ ID NO: 12847 - DNA, 1224 bp, Shewanella sp; identical to SEQ ID NO: 5657
  CDS (1)..(1224): transl_table=11

SEQ ID NO: 12848 - protein, 407 aa, Shewanella sp; identical to SEQ ID NO: 5658

SEQ ID NO: 12849 - DNA, 1344 bp, Shigella flexneri; identical to SEQ ID NO: 5659
  CDS (1)..(1344): transl_table=11

SEQ ID NO: 12850 - protein, 447 aa, Shigella flexneri; identical to SEQ ID NO: 5660

SEQ ID NO: 12851 - DNA, 1230 bp, Silicibacter pomeroyi; identical to SEQ ID NO: 5661
  CDS (1)..(1230): transl_table=11

SEQ ID NO: 12852 - protein, 409 aa, Silicibacter pomeroyi; identical to SEQ ID NO: 5662

SEQ ID NO: 12853 - DNA, 1224 bp, Silicibacter sp; identical to SEQ ID NO: 5663
  CDS (1)..(1224): transl_table=11

SEQ ID NO: 12854 - protein, 407 aa, Silicibacter sp; identical to SEQ ID NO: 5664

SEQ ID NO: 12855 - DNA, 1218 bp, Sphingopyxis alaskensis; identical to SEQ ID NO: 5665
  CDS (1)..(1218): transl_table=11

SEQ ID NO: 12856 - protein, 405 aa, Sphingopyxis alaskensis; identical to SEQ ID NO: 5666

SEQ ID NO: 12857 - DNA, 1206 bp, Staphylococcus aureus; identical to SEQ ID NO: 5667
  CDS (1)..(1206): transl_table=11

SEQ ID NO: 12858 - protein, 401 aa, Staphylococcus aureus; identical to SEQ ID NO: 5668

SEQ ID NO: 12859 - DNA, 1206 bp, Staphylococcus aureus; identical to SEQ ID NO: 5669
  CDS (1)..(1206): transl_table=11

SEQ ID NO: 12860 - protein, 401 aa, Staphylococcus aureus; identical to SEQ ID NO: 5670

SEQ ID NO: 12861 - DNA, 1206 bp, Staphylococcus epidermidis; identical to SEQ ID NO: 5671
  CDS (1)..(1206): transl_table=11

SEQ ID NO: 12862 - protein, 401 aa, Staphylococcus epidermidis; identical to SEQ ID NO: 5672

SEQ ID NO: 12863 - DNA, 1191 bp, Streptococcus agalactiae serotype III; identical to SEQ ID NO: 5673
  CDS (1)..(1191): transl_table=11

SEQ ID NO: 12864 - protein, 396 aa, Streptococcus agalactiae serotype III; identical to SEQ ID NO: 5674

SEQ ID NO: 12865 - DNA, 1191 bp, Streptococcus agalactiae serotype V; identical to SEQ ID NO: 5675
  CDS (1)..(1191): transl_table=11

SEQ ID NO: 12866 - protein, 396 aa, Streptococcus agalactiae serotype V; identical to SEQ ID NO: 5676

SEQ ID NO: 12867 - DNA, 1215 bp, Streptomyces avermitilis; identical to SEQ ID NO: 5677
  CDS (1)..(1215): transl_table=11

SEQ ID NO: 12868 - protein, 404 aa, Streptomyces avermitilis; identical to SEQ ID NO: 5678

SEQ ID NO: 12869 - DNA, 1194 bp, Streptomyces clavuligerus; identical to SEQ ID NO: 5679
  CDS (1)..(1194): transl_table=11

SEQ ID NO: 12870 - protein, 397 aa, Streptomyces clavuligerus; identical to SEQ ID NO: 5680

SEQ ID NO: 12871 - DNA, 1449 bp, Streptomyces lavendulae; identical to SEQ ID NO: 5681
  CDS (1)..(1449): transl_table=11

SEQ ID NO: 12872 - protein, 482 aa, Streptomyces lavendulae; identical to SEQ ID NO: 5682

SEQ ID NO: 12873 - DNA, 1191 bp, Streptococcus mutans; identical to SEQ ID NO: 5683
  CDS (1)..(1191): transl_table=11

SEQ ID NO: 12874 - protein, 396 aa, Streptococcus mutans; identical to SEQ ID NO: 5684

SEQ ID NO: 12875 - DNA, 1176 bp, Sulfolobus acidocaldarius; identical to SEQ ID NO: 5685
  CDS (1)..(1176): transl_table=11

SEQ ID NO: 12876 - protein, 391 aa, Sulfolobus acidocaldarius; identical to SEQ ID NO: 5686

SEQ ID NO: 12877 - DNA, 1173 bp, Sulfolobus tokodaii; identical to SEQ ID NO: 5687
  CDS (1)..(1173): transl_table=11

SEQ ID NO: 12878 - protein, 390 aa, Sulfolobus tokodaii; identical to SEQ ID NO: 5688

SEQ ID NO: 12879 - DNA, 1206 bp, Symbiobacterium thermophilum; identical to SEQ ID NO: 5689
  CDS (1)..(1206): transl_table=11

SEQ ID NO: 12880 - protein, 401 aa, Symbiobacterium thermophilum; identical to SEQ ID NO: 5690

SEQ ID NO: 12881 - DNA, 1206 bp, Syntrophus aciditrophicus; identical to SEQ ID NO: 5691
  CDS (1)..(1206): transl_table=11

SEQ ID NO: 12882 - protein, 401 aa, Syntrophus aciditrophicus; identical to SEQ ID NO: 5692

SEQ ID NO: 12883 - DNA, 1206 bp, Synechococcus elongatus; identical to SEQ ID NO: 5693
  CDS (1)..(1206): transl_table=11

SEQ ID NO: 12884 - protein, 401 aa, Synechococcus elongatus; identical to SEQ ID NO: 5694

SEQ ID NO: 12885 - DNA, 1203 bp, Synechococcus sp; identical to SEQ ID NO: 5695
  CDS (1)..(1203): transl_table=11

SEQ ID NO: 12886 - protein, 400 aa, Synechococcus sp; identical to SEQ ID NO: 5696

SEQ ID NO: 12887 - DNA, 1212 bp, Synechococcus sp; identical to SEQ ID NO: 5697
  CDS (1)..(1212): transl_table=11

SEQ ID NO: 12888 - protein, 403 aa, Synechococcus sp; identical to SEQ ID NO: 5698

SEQ ID NO: 12889 - DNA, 1206 bp, Synechococcus sp; identical to SEQ ID NO: 5699
  CDS (1)..(1206): transl_table=11

SEQ ID NO: 12890 - protein, 401 aa, Synechococcus sp; identical to SEQ ID NO: 5700

SEQ ID NO: 12891 - DNA, 1212 bp, Synechococcus sp; identical to SEQ ID NO: 5701
  CDS (1)..(1212): transl_table=11

SEQ ID NO: 12892 - protein, 403 aa, Synechococcus sp; identical to SEQ ID NO: 5702

SEQ ID NO: 12893 - DNA, 1203 bp, Synechocystis sp; identical to SEQ ID NO: 5703
  CDS (1)..(1203): transl_table=11

SEQ ID NO: 12894 - protein, 400 aa, Synechocystis sp; identical to SEQ ID NO: 5704

SEQ ID NO: 12895 - DNA, 1200 bp, Thermobifida fusca; identical to SEQ ID NO: 5707
  CDS (1)..(1200): transl_table=11

SEQ ID NO: 12896 - protein, 399 aa, Thermobifida fusca; identical to SEQ ID NO: 5708

SEQ ID NO: 12897 - DNA, 1230 bp, Thermotoga maritima; identical to SEQ ID NO: 5709
  CDS (1)..(1230): transl_table=11

SEQ ID NO: 12898 - protein, 409 aa, Thermotoga maritima; identical to SEQ ID NO: 5710

SEQ ID NO: 12899 - DNA, 1203 bp, Thermus thermophilus; identical to SEQ ID NO: 5711
  CDS (1)..(1203): transl_table=11

SEQ ID NO: 12900 - protein, 400 aa, Thermus thermophilus; identical to SEQ ID NO: 5712

SEQ ID NO: 12901 - DNA, 1233 bp, Thermoanaerobacter tengcongensis; identical to SEQ ID NO: 5713
  CDS (1)..(1233): transl_table=11

SEQ ID NO: 12902 - protein, 410 aa, Thermoanaerobacter tengcongensis; identical to SEQ ID NO: 5714

SEQ ID NO: 12903 - DNA, 1203 bp, Trichodesmium erythraeum; identical to SEQ ID NO: 5715
  CDS (1)..(1203): transl_table=11

SEQ ID NO: 12904 - protein, 400 aa, Trichodesmium erythraeum; identical to SEQ ID NO: 5716

SEQ ID NO: 12905 - DNA, 1215 bp, Vibrio cholerae; identical to SEQ ID NO: 5717
  CDS (1)..(1215): transl_table=11

SEQ ID NO: 12906 - protein, 404 aa, Vibrio cholerae; identical to SEQ ID NO: 5718

SEQ ID NO: 12907 - DNA, 1215 bp, Vibrio parahaemolyticus; identical to SEQ ID NO: 5719
  CDS (1)..(1215): transl_table=11

SEQ ID NO: 12908 - protein, 404 aa, Vibrio parahaemolyticus; identical to SEQ ID NO: 5720

SEQ ID NO: 12909 - DNA, 1215 bp, Wolinella succinogenes; identical to SEQ ID NO: 5721
  CDS (1)..(1215): transl_table=11

SEQ ID NO: 12910 - protein, 404 aa, Wolinella succinogenes; identical to SEQ ID NO: 5722

SEQ ID NO: 12911 - DNA, 1194 bp, Xanthomonas campestris pv; identical to SEQ ID NO: 5723
  CDS (1)..(1194): transl_table=11

SEQ ID NO: 12912 - protein, 397 aa, Xanthomonas campestris pv; identical to SEQ ID NO: 5724

SEQ ID NO: 12913 - DNA, 1206 bp, Xylella fastidiosa; identical to SEQ ID NO: 5725
  CDS (1)..(1206): transl_table=11

SEQ ID NO: 12914 - protein, 401 aa, Xylella fastidiosa; identical to SEQ ID NO: 5726

SEQ ID NO: 12915 - DNA, 1206 bp, Xylella fastidiosa; identical to SEQ ID NO: 5727
  CDS (1)..(1206): transl_table=11

SEQ ID NO: 12916 - protein, 401 aa, Xylella fastidiosa; identical to SEQ ID NO: 5728

SEQ ID NO: 12917 - DNA, 1368 bp, Yersinia pestis; identical to SEQ ID NO: 5729
  CDS (1)..(1368): transl_table=11

SEQ ID NO: 12918 - protein, 455 aa, Yersinia pestis; identical to SEQ ID NO: 5730

SEQ ID NO: 12919 - DNA, 1227 bp, Zymomonas mobilis; identical to SEQ ID NO: 5731
  CDS (1)..(1227): transl_table=11

SEQ ID NO: 12920 - protein, 408 aa, Zymomonas mobilis; identical to SEQ ID NO: 5732

SEQ ID NO: 12921 - DNA, 1446 bp, Oryza sativa; identical to SEQ ID NO: 5733
  CDS (1)..(1446)

SEQ ID NO: 12922 - protein, 481 aa, Oryza sativa; identical to SEQ ID NO: 5734

SEQ ID NO: 12923 - DNA, 1263 bp, Saccharomyces cerevisiae; identical to SEQ ID NO: 5159
  CDS (1)..(1263)

SEQ ID NO: 12924 - protein, 420 aa, Saccharomyces cerevisiae; identical to SEQ ID NO: 5160

SEQ ID NO: 12925 - DNA, 1434 bp, Glycine max; identical to SEQ ID NO: 5735
  CDS (1)..(1434)

SEQ ID NO: 12926 - protein, 477 aa, Glycine max; identical to SEQ ID NO: 5736

SEQ ID NO: 12927 - DNA, 1434 bp, Glycine max; identical to SEQ ID NO: 5737
  CDS (1)..(1434)

SEQ ID NO: 12928 - protein, 477 aa, Glycine max; identical to SEQ ID NO: 5738

SEQ ID NO: 12929 - DNA, 1446 bp, Zea mays; identical to SEQ ID NO: 5739
  CDS (1)..(1446)

SEQ ID NO: 12930 - protein, 481 aa, Zea mays; identical to SEQ ID NO: 5740

SEQ ID NO: 12931 - DNA, 25 bp, Artificial sequence
  primer
atgtctaagggaaaagtttgtttgg

SEQ ID NO: 12932 - DNA, 25 bp, Artificial sequence
  primer
ttacaaagtcaactcttcacctttg

SEQ ID NO: 12933 - protein, 425 aa, Artificial sequence; identical to SEQ ID NO: 5743
  consensus sequence
  Variant (11)..(13): Xaa in position 11 to 13 is any amino acid
  Variant (14)..(24): Xaa in position 14 to 24 is any or no amino acid
  Variant (26)..(32): Xaa in position 26 to 32 is any amino acid
  Variant (33)..(33): Xaa in position 33 is any or no amino acid
  Variant (36)..(45): Xaa in position 36 to 45 is any amino acid
  Variant (46)..(47): Xaa in position 46 to 47 is any or no amino acid
  Variant (49)..(51): Xaa in position 49 to 51 is any amino acid
  Variant (53)..(58): Xaa in position 53 to 58 is any amino acid
  Variant (59)..(61): Xaa in position 59 to 61 is any or no amino acid
  Variant (63)..(80): Xaa in position 63 to 80 is any amino acid
  Variant (81)..(81): Xaa in position 81 is any or no amino acid
  Variant (83)..(84): Xaa in position 83 to 84 is any amino acid
  Variant (85)..(88): Xaa in position 85 to 88 is any or no amino acid
  Variant (90)..(90): Xaa in position 90 is any amino acid
  Variant (92)..(95): Xaa in position 92 to 95 is any amino acid
  Variant (96)..(96): Xaa in position 96 is any or no amino acid
  Variant (99)..(99): Xaa in position 99 is any amino acid
  Variant (101)..(107): Xaa in position 101 to 107 is any amino acid
  Variant (109)..(116): Xaa in position 109 to 116 is any amino acid
  Variant (117)..(117): Xaa in position 117 is any or no amino acid
  Variant (120)..(120): Xaa in position 120 is any amino acid
  Variant (128)..(128): Xaa in position 128 is any amino acid
  Variant (131)..(135): Xaa in position 131 to 135 is any amino acid
  Variant (136)..(138): Xaa in position 136 to 138 is any or no amino acid
  Variant (140)..(143): Xaa in position 140 to 143 is any amino acid
  Variant (144)..(146): Xaa in position 144 to 146 is any or no amino acid
  Variant (148)..(148): Xaa in position 148 is any amino acid
  Variant (150)..(151): Xaa in position 150 to 151 is any amino acid
  Variant (152)..(159): Xaa in position 152 to 159 is any or no amino acid
  Variant (161)..(178): Xaa in position 161 to 178 is any amino acid
  Variant (179)..(185): Xaa in position 179 to 185 is any or no amino acid
  Variant (187)..(187): Xaa in position 187 is any amino acid
  Variant (189)..(189): Xaa in position 189 is any amino acid
  Variant (191)..(196): Xaa in position 191 to 196 is any amino acid
  Variant (198)..(200): Xaa in position 198 to 200 is any amino acid
  Variant (203)..(228): Xaa in position 203 to 228 is any amino acid
  Variant (229)..(234): Xaa in position 229 to 234 is any or no amino acid
  Variant (236)..(237): Xaa in position 236 to 237 is any amino acid
  Variant (239)..(244): Xaa in position 239 to 244 is any amino acid
  Variant (246)..(256): Xaa in position 246 to 256 is any amino acid
  Variant (257)..(266): Xaa in position 257 to 266 is any or no amino acid
  Variant (268)..(273): Xaa in position 268 to 273 is any amino acid
  Variant (275)..(275): Xaa in position 275 is any amino acid
  Variant (277)..(278): Xaa in position 277 to 278 is any amino acid
  Variant (280)..(281): Xaa in position 280 to 281 is any amino acid
  Variant (283)..(283): Xaa in position 283 is any amino acid
  Variant (285)..(286): Xaa in position 285 to 286 is any amino acid
  Variant (288)..(288): Xaa in position 288 is any amino acid
  Variant (292)..(293): Xaa in position 292 to 293 is any amino acid
  Variant (296)..(296): Xaa in position 296 is any amino acid
  Variant (298)..(304): Xaa in position 298 to 304 is any amino acid
  Variant (306)..(309): Xaa in position 306 to 309 is any amino acid
  Variant (310)..(310): Xaa in position 310 is any or no amino acid
  Variant (312)..(333): Xaa in position 312 to 333 is any amino acid
  Variant (334)..(335): Xaa in position 334 to 335 is any or no amino acid
  Variant (337)..(337): Xaa in position 337 is any amino acid
  Variant (339)..(339): Xaa in position 339 is any amino acid
  Variant (341)..(342): Xaa in position 341 to 342 is any amino acid
  Variant (344)..(347): Xaa in position 344 to 347 is any amino acid
  Variant (349)..(358): Xaa in position 349 to 358 is any amino acid
  Variant (359)..(359): Xaa in position 359 is any or no amino acid
  Variant (361)..(361): Xaa in position 361 is any amino acid
  Variant (363)..(363): Xaa in position 363 is any amino acid
  Variant (365)..(367): Xaa in position 365 to 367 is any amino acid
  Variant (369)..(370): Xaa in position 369 to 370 is any amino acid
  Variant (372)..(379): Xaa in position 372 to 379 is any amino acid
  Variant (381)..(382): Xaa in position 381 to 382 is any amino acid
  Variant (383)..(384): Xaa in position 383 to 384 is any or no amino acid
  Variant (387)..(402): Xaa in position 387 to 402 is any amino acid
  Variant (403)..(408): Xaa in position 403 to 408 is any or no amino acid
  Variant (411)..(415): Xaa in position 411 to 415 is any amino acid
  Variant (416)..(424): Xaa in position 416 to 424 is any or no amino acid

SEQ ID NO: 12934 - protein, 14 aa, Artificial sequence
  protein pattern
  Variant (3)..(3): Xaa in position 3 is Ala, Cys or Ser
  Variant (6)..(6): Xaa in position 6 is any amino acid
  Variant (11)..(11): Xaa in position 11 is Phe, Ile, Leu or Val
  Variant (14)..(14): Xaa in position 14 is Asp or Glu
HGXTGXGNDQXRFX

SEQ ID NO: 12935 - protein, 12 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is Phe or Tyr
VXXAXSGGLDTS

SEQ ID NO: 12936 - DNA, 1113 bp, Saccharomyces cerevisiae
  CDS (1)..(1113)
atggctgaagcaagcatcgaaaagactcaaattttacaaaaatatctagaactggaccaaagaggtagaataattgccgaatacgtttggatcgatggtactggtaacttacgttccaaaggtagaactttgaagaagagaatcacatccattgaccaattgccagaatggaacttcgacggttcttctaccaaccaagcgccaggccacgactctgacatctatttgaaacccgttgcttactacccagatcccttcaggagaggtgacaacattgttgtcttggccgcatgttacaacaatgacggtactccaaacaagttcaaccacagacacgaagctgccaagctatttgctgctcataaggatgaagaaatctggtttggtctagaacaagaatacactctatttgacatgtatgacgatgtttacggatggccaaagggtgggtacccagctccacaaggtccttactactgtggtgttggtgccggtaaggtttatgccagagacatgatcgaagctcactacagagcttgtttgtatgccggattagaaatttctggtattaacgctgaagtcatgccatctcaatgggaattccaagtcggtccatgtaccggtattgacatgggtgaccaattatggatggccagatactttttgcacagagtggcagaagagtttggtatcaagatctcattccatccaaagccattgaagggtgactggaacggtgccggttgtcacactaacgtttccaccaaggaaatgagacaaccaggtggtatgaaatacatcgaacaagccatcgagaagttatccaagagacacgctgaacacattaagttgtacggtagcgataacgacatgagattaactggtagacatgaaaccgcttccatgactgccttttcttctggtgtcgccaacagaggtagctcaattagaatcccaagatccgtcgccaaggaaggttacggttactttgaagaccgtagaccagcttccaacatcgacccatacttggttacaggtatcatgtgtgaaactgtttgcggtgctattgacaatgctgacatgacgaaggaatttgaaagagaatcttcataa

SEQ ID NO: 12937 - protein, 370 aa, Saccharomyces cerevisiae
MAEASIEKTQILQKYLELDQRGRIIAEYVWIDGTGNLRSKGRTLKKRITSIDQLPEWNFDGSSTNQAPGHDSDIYLKPVAYYPDPFRRGDNIVVLAACYNNDGTPNKFNHRHEAAKLFAAHKDEEIWFGLEQEYTLFDMYDDVYGWPKGGYPAPQGPYYCGVGAGKVYARDMIEAHYRACLYAGLEISGINAEVMPSQWEFQVGPCTGIDMGDQLWMARYFLHRVAEEFGIKISFHPKPLKGDWNGAGCHTNVSTKEMRQPGGMKYIEQAIEKLSKRHAEHIKLYGSDNDMRLTGRHETASMTAFSSGVANRGSSIRIPRSVAKEGYGYFEDRRPASNIDPYLVTGIMCETVCGAIDNADMTKEFERESS

SEQ ID NO: 12938 - DNA, 1041 bp, Mesorhizobium loti MAFF303099; identical to SEQ ID NO: 2083
  CDS (1)..(1041): transl_table=11

SEQ ID NO: 12939 - protein, 346 aa, Mesorhizobium loti MAFF303099; identical to SEQ ID NO: 2084

SEQ ID NO: 12940 - DNA, 1104 bp, Agrobacterium tumefaciens str. C58; identical to SEQ ID NO: 2085
  CDS (1)..(1104): transl_table=11

SEQ ID NO: 12941 - protein, 367 aa, Agrobacterium tumefaciens str. C58; identical to SEQ ID NO: 2086

SEQ ID NO: 12942 - DNA, 1035 bp, Sinorhizobium meliloti 1021; identical to SEQ ID NO: 2087
  CDS (1)..(1035): transl_table=11

SEQ ID NO: 12943 - protein, 344 aa, Sinorhizobium meliloti 1021; identical to SEQ ID NO: 2088

SEQ ID NO: 12944 - DNA, 1035 bp, Agrobacterium tumefaciens str. C58; identical to SEQ ID NO: 2089
  CDS (1)..(1035): transl_table=11

SEQ ID NO: 12945 - protein, 344 aa, Agrobacterium tumefaciens str. C58; identical to SEQ ID NO: 2090

SEQ ID NO: 12946 - DNA, 1032 bp, Streptomyces coelicolor A3(2); identical to SEQ ID NO: 2091
  CDS (1)..(1032): transl_table=11

SEQ ID NO: 12947 - protein, 343 aa, Streptomyces coelicolor A3(2); identical to SEQ ID NO: 2092

SEQ ID NO: 12948 - DNA, 1080 bp, Coxiella burnetii RSA 493; identical to SEQ ID NO: 2093
  CDS (1)..(1080): transl_table=11

SEQ ID NO: 12949 - protein, 359 aa, Coxiella burnetii RSA 493; identical to SEQ ID NO: 2094

SEQ ID NO: 12950 - DNA, 1029 bp, Streptomyces avermitilis MA-4680; identical to SEQ ID NO: 2095
  CDS (1)..(1029): transl_table=11

SEQ ID NO: 12951 - protein, 342 aa, Streptomyces avermitilis MA-4680; identical to SEQ ID NO: 2096

SEQ ID NO: 12952 - DNA, 1101 bp, Rhodopirellula baltica SH 1; identical to SEQ ID NO: 2097
  CDS (1)..(1101): transl_table=11

SEQ ID NO: 12953 - protein, 366 aa, Rhodopirellula baltica SH 1; identical to SEQ ID NO: 2098

SEQ ID NO: 12954 - DNA, 1038 bp, Rhodopseudomonas palustris CGA009; identical to SEQ ID NO: 2099
  CDS (1)..(1038): transl_table=11

SEQ ID NO: 12955 - protein, 345 aa, Rhodopseudomonas palustris CGA009; identical to SEQ ID NO: 2100

SEQ ID NO: 12956 - DNA, 1077 bp, Magnaporthe grisea 70-15; identical to SEQ ID NO: 2101
  CDS (1)..(1077)

SEQ ID NO: 12957 - protein, 358 aa, Magnaporthe grisea 70-15; identical to SEQ ID NO: 2102

SEQ ID NO: 12958 - DNA, 1029 bp, Magnaporthe grisea 70-15; identical to SEQ ID NO: 2103
  CDS (1)..(1029)

SEQ ID NO: 12959 - protein, 342 aa, Magnaporthe grisea 70-15; identical to SEQ ID NO: 2104

SEQ ID NO: 12960 - DNA, 1065 bp, Gibberella zeae PH-1; identical to SEQ ID NO: 2105
  CDS (1)..(1065)

SEQ ID NO: 12961 - protein, 354 aa, Gibberella zeae PH-1; identical to SEQ ID NO: 2106

SEQ ID NO: 12962 - DNA, 1038 bp, Aspergillus nidulans FGSC A4; identical to SEQ ID NO: 2107
  CDS (1)..(1038)

SEQ ID NO: 12963 - protein, 345 aa, Aspergillus nidulans FGSC A4; identical to SEQ ID NO: 2108

SEQ ID NO: 12964 - DNA, 1122 bp, Candida albicans SC5314; identical to SEQ ID NO: 2109
  CDS (1)..(1122): transl_table=12

SEQ ID NO: 12965 - protein, 373 aa, Candida albicans SC5314; identical to SEQ ID NO: 2110

SEQ ID NO: 12966 - DNA, 1122 bp, Candida albicans SC5314; identical to SEQ ID NO: 2111
  CDS (1)..(1122): transl_table=12

SEQ ID NO: 12967 - protein, 373 aa, Candida albicans SC5314; identical to SEQ ID NO: 2112

SEQ ID NO: 12968 - DNA, 1200 bp, Ustilago maydis 521; identical to SEQ ID NO: 2113
  CDS (1)..(1200)

SEQ ID NO: 12969 - protein, 399 aa, Ustilago maydis 521; identical to SEQ ID NO: 2114

SEQ ID NO: 12970 - DNA, 1062 bp, Frankia sp. CcI3; identical to SEQ ID NO: 2115
  CDS (1)..(1062): transl_table=11

SEQ ID NO: 12971 - protein, 353 aa, Frankia sp. CcI3; identical to SEQ ID NO: 2116

SEQ ID NO: 12972 - DNA, 1038 bp, Francisella tularensis subsp. holarctica; identical to SEQ ID NO: 2117
  CDS (1)..(1038): transl_table=11

SEQ ID NO: 12973 - protein, 345 aa, Francisella tularensis subsp. holarctica; identical to SEQ ID NO: 2118

SEQ ID NO: 12974 - DNA, 1020 bp, Cytophaga hutchinsonii ATCC 33406; identical to SEQ ID NO: 2119
  CDS (1)..(1020): transl_table=11

SEQ ID NO: 12975 - protein, 339 aa, Cytophaga hutchinsonii ATCC 33406; identical to SEQ ID NO: 2120

SEQ ID NO: 12976 - DNA, 1041 bp, Rhizobium leguminosarum bv. viciae 3841; identical to SEQ ID NO: 2121
  CDS (1)..(1041): transl_table=11

SEQ ID NO: 12977 - protein, 346 aa, Rhizobium leguminosarum bv. viciae 3841; identical to SEQ ID NO: 2122

SEQ ID NO: 12978 - DNA, 1035 bp, Xanthobacter autotrophicus Py2; identical to SEQ ID NO: 2123
  CDS (1)..(1035): transl_table=11

SEQ ID NO: 12979 - protein, 344 aa, Xanthobacter autotrophicus Py2; identical to SEQ ID NO: 2124

SEQ ID NO: 12980 - DNA, 1071 bp, Camellia sinensis; identical to SEQ ID NO: 2125
  CDS (1)..(1071)

SEQ ID NO: 12981 - protein, 356 aa, Camellia sinensis; identical to SEQ ID NO: 2126

SEQ ID NO: 12982 - DNA, 1305 bp, Pisum sativum; identical to SEQ ID NO: 2127
  CDS (71)..(1141)

SEQ ID NO: 12983 - protein, 356 aa, Pisum sativum; identical to SEQ ID NO: 2128

SEQ ID NO: 12984 - DNA, 1597 bp, Brassica napus; identical to SEQ ID NO: 2129
  CDS (97)..(1383)

SEQ ID NO: 12985 - protein, 428 aa, Brassica napus; identical to SEQ ID NO: 2130

SEQ ID NO: 12986 - DNA, 1344 bp, Brassica napus; identical to SEQ ID NO: 2131
  CDS (32)..(1102)

SEQ ID NO: 12987 - protein, 356 aa, Brassica napus; identical to SEQ ID NO: 2132

SEQ ID NO: 12988 - DNA, 1425 bp, Medicago truncatula; identical to SEQ ID NO: 2133
  CDS (73)..(1143)

SEQ ID NO: 12989 - protein, 356 aa, Medicago truncatula; identical to SEQ ID NO: 2134

SEQ ID NO: 12990 - DNA, 1488 bp, Medicago truncatula; identical to SEQ ID NO: 2135
  CDS (145)..(1215)

SEQ ID NO: 12991 - protein, 356 aa, Medicago truncatula; identical to SEQ ID NO: 2136

SEQ ID NO: 12992 - DNA, 1333 bp, Raphanus sativus; identical to SEQ ID NO: 2137
  CDS (37)..(1101)

SEQ ID NO: 12993 - protein, 354 aa, Raphanus sativus; identical to SEQ ID NO: 2138

SEQ ID NO: 12994 - DNA, 1484 bp, Raphanus sativus; identical to SEQ ID NO: 2139
  CDS (170)..(1240)

SEQ ID NO: 12995 - protein, 356 aa, Raphanus sativus; identical to SEQ ID NO: 2140

SEQ ID NO: 12996 - DNA, 1326 bp, Raphanus sativus; identical to SEQ ID NO: 2141
  CDS (65)..(1135)

SEQ ID NO: 12997 - protein, 356 aa, Raphanus sativus; identical to SEQ ID NO: 2142

SEQ ID NO: 12998 - DNA, 1152 bp, Phaeosphaeria nodorum; identical to SEQ ID NO: 2143
  CDS (1)..(1152)

SEQ ID NO: 12999 - protein, 383 aa, Phaeosphaeria nodorum; identical to SEQ ID NO: 2144

SEQ ID NO: 13000 - DNA, 1440 bp, Arabidopsis thaliana; identical to SEQ ID NO: 2145
  CDS (92)..(1162)

SEQ ID NO: 13001 - protein, 356 aa, Arabidopsis thaliana; identical to SEQ ID NO: 2146

SEQ ID NO: 13002 - DNA, 1308 bp, Stevia rebaudiana; identical to SEQ ID NO: 2147
  CDS (7)..(1068)

SEQ ID NO: 13003 - protein, 353 aa, Stevia rebaudiana; identical to SEQ ID NO: 2148

SEQ ID NO: 13004 - DNA, 1161 bp, Helicosporidium sp; identical to SEQ ID NO: 2149
  CDS (1)..(1161)

SEQ ID NO: 13005 - protein, 386 aa, Helicosporidium sp; identical to SEQ ID NO: 2150

SEQ ID NO: 13006 - DNA, 1071 bp, Aspergillus oryzae; identical to SEQ ID NO: 2151
  CDS (1)..(1071)

SEQ ID NO: 13007 - protein, 356 aa, Aspergillus oryzae; identical to SEQ ID NO: 2152

SEQ ID NO: 13008 - DNA, 1807 bp, Cucumis melo; identical to SEQ ID NO: 2153
  CDS (171)..(1469)
  misc_feature (783)..(783): w is a or t
  misc_feature (814)..(814): r is g or a

SEQ ID NO: 13009 - protein, 432 aa, Cucumis melo; identical to SEQ ID NO: 2154
  misc_feature (205)..(205): The Xaa at location 205 stands for Arg, or Trp.
  misc_feature (215)..(215): The Xaa at location 215 stands for Asp, or Gly.

SEQ ID NO: 13010 - DNA, 1354 bp, Brassica napus; identical to SEQ ID NO: 2155
  CDS (62)..(1132)

SEQ ID NO: 13011 - protein, 356 aa, Brassica napus; identical to SEQ ID NO: 2156

SEQ ID NO: 13012 - DNA, 1400 bp, Brassica napus; identical to SEQ ID NO: 2157
  CDS (68)..(1138)

SEQ ID NO: 13013 - protein, 356 aa, Brassica napus; identical to SEQ ID NO: 2158

SEQ ID NO: 13014 - DNA, 1433 bp, Glycine max; identical to SEQ ID NO: 2159
  CDS (70)..(1137)

SEQ ID NO: 13015 - protein, 355 aa, Glycine max; identical to SEQ ID NO: 2160

SEQ ID NO: 13016 - DNA, 1071 bp, Nicotiana tabacum; identical to SEQ ID NO: 2161
  CDS (1)..(1071)

SEQ ID NO: 13017 - protein, 356 aa, Nicotiana tabacum; identical to SEQ ID NO: 2162

SEQ ID NO: 13018 - DNA, 1381 bp, Nicotiana tabacum; identical to SEQ ID NO: 2163
  CDS (54)..(1124)

SEQ ID NO: 13019 - protein, 356 aa, Nicotiana tabacum; identical to SEQ ID NO: 2164

SEQ ID NO: 13020 - DNA, 1310 bp, Glycine max; identical to SEQ ID NO: 2165
  CDS (62)..(1129)

SEQ ID NO: 13021 - protein, 355 aa, Glycine max; identical to SEQ ID NO: 2166

SEQ ID NO: 13022 - DNA, 1689 bp, Triticum aestivum; identical to SEQ ID NO: 2167
  CDS (140)..(1423)

SEQ ID NO: 13023 - protein, 427 aa, Triticum aestivum; identical to SEQ ID NO: 2168

SEQ ID NO: 13024 - DNA, 1593 bp, Triticum aestivum; identical to SEQ ID NO: 2169
  CDS (114)..(1397)

SEQ ID NO: 13025 - protein, 427 aa, Triticum aestivum; identical to SEQ ID NO: 2170

SEQ ID NO: 13026 - DNA, 1713 bp, Triticum aestivum; identical to SEQ ID NO: 2171
  CDS (185)..(1468)

SEQ ID NO: 13027 - protein, 427 aa, Triticum aestivum; identical to SEQ ID NO: 2172

SEQ ID NO: 13028 - DNA, 1071 bp, Triticum aestivum; identical to SEQ ID NO: 2173
  CDS (1)..(1071)

SEQ ID NO: 13029 - protein, 356 aa, Triticum aestivum; identical to SEQ ID NO: 2174

SEQ ID NO: 13030 - DNA, 1071 bp, Triticum aestivum; identical to SEQ ID NO: 2175
  CDS (1)..(1071)

SEQ ID NO: 13031 - protein, 356 aa, Triticum aestivum; identical to SEQ ID NO: 2176

SEQ ID NO: 13032 - DNA, 1292 bp, Triticum aestivum; identical to SEQ ID NO: 2177
  CDS (64)..(1134)

SEQ ID NO: 13033 - protein, 356 aa, Triticum aestivum; identical to SEQ ID NO: 2178

SEQ ID NO: 13034 - DNA, 1241 bp, Paxillus involutus; identical to SEQ ID NO: 2179
  CDS (55)..(1122)

SEQ ID NO: 13035 - protein, 355 aa, Paxillus involutus; identical to SEQ ID NO: 2180

SEQ ID NO: 13036 - DNA, 1508 bp, Camellia sinensis; identical to SEQ ID NO: 2181
  CDS (146)..(1216)

SEQ ID NO: 13037 - protein, 356 aa, Camellia sinensis; identical to SEQ ID NO: 2182

SEQ ID NO: 13038 - DNA, 1595 bp, Camellia sinensis; identical to SEQ ID NO: 2183
  CDS (82)..(1152)

SEQ ID NO: 13039 - protein, 356 aa, Camellia sinensis; identical to SEQ ID NO: 2184

SEQ ID NO: 13040 - DNA, 1477 bp, Saccharum officinarum; identical to SEQ ID NO: 2185
  CDS (86)..(1189)
  misc_feature (1458)..(1458): n is a, g, c or t

SEQ ID NO: 13041 - protein, 367 aa, Saccharum officinarum; identical to SEQ ID NO: 2186

SEQ ID NO: 13042 - DNA, 1422 bp, Saccharum officinarum; identical to SEQ ID NO: 2187
  CDS (67)..(1140)

SEQ ID NO: 13043 - protein, 357 aa, Saccharum officinarum; identical to SEQ ID NO: 2188

SEQ ID NO: 13044 - DNA, 1596 bp, Saccharum officinarum; identical to SEQ ID NO: 2189
  CDS (83)..(1153)

SEQ ID NO: 13045 - protein, 356 aa, Saccharum officinarum; identical to SEQ ID NO: 2190

SEQ ID NO: 13046 - DNA, 1418 bp, Nicotiana attenuata; identical to SEQ ID NO: 2191
  CDS (43)..(1113)

SEQ ID NO: 13047 - protein, 356 aa, Nicotiana attenuata; identical to SEQ ID NO: 2192

SEQ ID NO: 13048 - DNA, 1293 bp, Lotus japonicus; identical to SEQ ID NO: 2193
  CDS (1)..(1293)

SEQ ID NO: 13049 - protein, 430 aa, Lotus japonicus; identical to SEQ ID NO: 2194

SEQ ID NO: 13050 - DNA, 1293 bp, Lotus japonicus; identical to SEQ ID NO: 2195
  CDS (1)..(1293)

SEQ ID NO: 13051 - protein, 430 aa, Lotus japonicus; identical to SEQ ID NO: 2196

SEQ ID NO: 13052 - DNA, 1523 bp, Nicotiana attenuata; identical to SEQ ID NO: 2197
  CDS (51)..(1349)

SEQ ID NO: 13053 - protein, 432 aa, Nicotiana attenuata; identical to SEQ ID NO: 2198

SEQ ID NO: 13054 - DNA, 1359 bp, Elaeagnus umbellata; identical to SEQ ID NO: 2199
  CDS (36)..(1103)

SEQ ID NO: 13055 - protein, 355 aa, Elaeagnus umbellata; identical to SEQ ID NO: 2200

SEQ ID NO: 13056 - DNA, 1278 bp, Triticum aestivum; identical to SEQ ID NO: 2201
  CDS (116)..(1204)

SEQ ID NO: 13057 - protein, 362 aa, Triticum aestivum; identical to SEQ ID NO: 2202

SEQ ID NO: 13058 - DNA, 1299 bp, Triticum aestivum; identical to SEQ ID NO: 2203
  CDS (82)..(1170)

SEQ ID NO: 13059 - protein, 362 aa, Triticum aestivum; identical to SEQ ID NO: 2204

SEQ ID NO: 13060 - DNA, 1341 bp, Triticum aestivum; identical to SEQ ID NO: 2205
  CDS (28)..(1092)

SEQ ID NO: 13061 - protein, 354 aa, Triticum aestivum; identical to SEQ ID NO: 2206

SEQ ID NO: 13062 - DNA, 1397 bp, Triticum aestivum; identical to SEQ ID NO: 2207
  CDS (78)..(1142)

SEQ ID NO: 13063 - protein, 354 aa, Triticum aestivum; identical to SEQ ID NO: 2208

SEQ ID NO: 13064 - DNA, 1445 bp, Datisca glomerata; identical to SEQ ID NO: 2209
  CDS (77)..(1147)

SEQ ID NO: 13065 - protein, 356 aa, Datisca glomerata; identical to SEQ ID NO: 2210

SEQ ID NO: 13066 - DNA, 1065 bp, Glomus mosseae; identical to SEQ ID NO: 2211
  CDS (1)..(1065)
  misc_feature (435)..(435): w is a or t

SEQ ID NO: 13067 - protein, 354 aa, Glomus mosseae; identical to SEQ ID NO: 2212

SEQ ID NO: 13068 - DNA, 1290 bp, Phragmites australis; identical to SEQ ID NO: 2213
  CDS (1)..(1290)

SEQ ID NO: 13069 - protein, 429 aa, Phragmites australis; identical to SEQ ID NO: 2214

SEQ ID NO: 13070 - DNA, 1290 bp, Phragmites australis; identical to SEQ ID NO: 2215
  CDS (1)..(1290)

SEQ ID NO: 13071 - protein, 429 aa, Phragmites australis; identical to SEQ ID NO: 2216

SEQ ID NO: 13072 - DNA, 1409 bp, Camellia sinensis; identical to SEQ ID NO: 2217
  CDS (126)..(1196)

SEQ ID NO: 13073 - protein, 356 aa, Camellia sinensis; identical to SEQ ID NO: 2218

SEQ ID NO: 13074 - DNA, 1401 bp, Securigera parviflora; identical to SEQ ID NO: 2219
  CDS (99)..(1169)

SEQ ID NO: 13075 - protein, 356 aa, Securigera parviflora; identical to SEQ ID NO: 2220

SEQ ID NO: 13076 - DNA, 1508 bp, Securigera parviflora; identical to SEQ ID NO: 2221
  CDS (105)..(1175)

SEQ ID NO: 13077 - protein, 356 aa, Securigera parviflora; identical to SEQ ID NO: 2222

SEQ ID NO: 13078 - DNA, 1552 bp, Medicago truncatula; identical to SEQ ID NO: 2223
  CDS (41)..(1327)

SEQ ID NO: 13079 - protein, 428 aa, Medicago truncatula; identical to SEQ ID NO: 2224

SEQ ID NO: 13080 - DNA, 1436 bp, Lotus japonicus; identical to SEQ ID NO: 2225
  CDS (1)..(1293)
  misc_feature (1375)..(1375): n is a, g, c or t
  misc_feature (1425)..(1425): n is a, g, c or t

SEQ ID NO: 13081 - protein, 430 aa, Lotus japonicus; identical to SEQ ID NO: 2226

SEQ ID NO: 13082 - DNA, 1665 bp, Spiraea nipponica; identical to SEQ ID NO: 2227
  CDS (86)..(1375)

SEQ ID NO: 13083 - protein, 429 aa, Spiraea nipponica; identical to SEQ ID NO: 2228

SEQ ID NO: 13084 - DNA, 1299 bp, Crataegus crus; identical to SEQ ID NO: 2229
  CDS (1)..(1299)

SEQ ID NO: 13085 - protein, 432 aa, Crataegus crus; identical to SEQ ID NO: 2230

SEQ ID NO: 13086 - DNA, 1696 bp, Lotus japonicus; identical to SEQ ID NO: 2231
  CDS (147)..(1439)
  misc_feature (934)..(934): n is a, g, c or t
  misc_feature (997)..(997): n is a, g, c or t

SEQ ID NO: 13087 - protein, 430 aa, Lotus japonicus; identical to SEQ ID NO: 2232
  misc_feature (263)..(263): The Xaa at location 263 stands for Asn, Ile, Ser, or Thr.
  misc_feature (284)..(284): The Xaa at location 284 stands for Ala, Glu, Gly, or Val.

SEQ ID NO: 13088 - DNA, 1338 bp, Vitis vinifera; identical to SEQ ID NO: 2233
  CDS (27)..(1097)

SEQ ID NO: 13089 - protein, 356 aa, Vitis vinifera; identical to SEQ ID NO: 2234

SEQ ID NO: 13090 - DNA, 1557 bp, Populus tremula x Populus alba; identical to SEQ ID NO: 2235
  CDS (114)..(1184)

SEQ ID NO: 13091 - protein, 356 aa, Populus tremula x Populus alba; identical to SEQ ID NO: 2236

SEQ ID NO: 13092 - DNA, 1541 bp, Glycine max; identical to SEQ ID NO: 2237
  CDS (30)..(1328)

SEQ ID NO: 13093 - protein, 432 aa, Glycine max; identical to SEQ ID NO: 2238

SEQ ID NO: 13094 - DNA, 1296 bp, Beta vulgaris subsp; identical to SEQ ID NO: 2239
  CDS (1)..(1296)

SEQ ID NO: 13095 - protein, 431 aa, Beta vulgaris subsp; identical to SEQ ID NO: 2240

SEQ ID NO: 13096 - DNA, 1071 bp, Beta vulgaris subsp; identical to SEQ ID NO: 2241
  CDS (1)..(1071)

SEQ ID NO: 13097 - protein, 356 aa, Beta vulgaris subsp; identical to SEQ ID NO: 2242

SEQ ID NO: 13098 - DNA, 1374 bp, Avicennia marina; identical to SEQ ID NO: 2243
  CDS (65)..(1135)

SEQ ID NO: 13099 - protein, 356 aa, Avicennia marina; identical to SEQ ID NO: 2244

SEQ ID NO: 13100 - DNA, 1403 bp, Glycine max; identical to SEQ ID NO: 2245
  CDS (60)..(1130)

SEQ ID NO: 13101 - protein, 356 aa, Glycine max; identical to SEQ ID NO: 2246

SEQ ID NO: 13102 - DNA, 1577 bp, Canavalia lineata; identical to SEQ ID NO: 2247
  CDS (91)..(1383)

SEQ ID NO: 13103 - protein, 430 aa, Canavalia lineata; identical to SEQ ID NO: 2248

SEQ ID NO: 13104 - DNA, 1666 bp, Juglans nigra; identical to SEQ ID NO: 2249
  CDS (96)..(1394)

SEQ ID NO: 13105 - protein, 432 aa, Juglans nigra; identical to SEQ ID NO: 2250

SEQ ID NO: 13106 - DNA, 1590 bp, Nicotiana sylvestris; identical to SEQ ID NO: 2251
  CDS (67)..(1365)

SEQ ID NO: 13107 - protein, 432 aa, Nicotiana sylvestris; identical to SEQ ID NO: 2252

SEQ ID NO: 13108 - DNA, 1345 bp, Canavalia lineata; identical to SEQ ID NO: 2253
  CDS (83)..(1150)

SEQ ID NO: 13109 - protein, 355 aa, Canavalia lineata; identical to SEQ ID NO: 2254

SEQ ID NO: 13110 - DNA, 1579 bp, Mesembryanthemum crystallinum; identical to SEQ ID NO: 2255
  CDS (88)..(1389)
  misc_feature (1405)..(1405): n is a, g, c or t

SEQ ID NO: 13111 - protein, 433 aa, Mesembryanthemum crystallinum; identical to SEQ ID NO: 2256

SEQ ID NO: 13112 - DNA, 1451 bp, Pinus sylvestris; identical to SEQ ID NO: 2257
  CDS (78)..(1145)

SEQ ID NO: 13113 - protein, 355 aa, Pinus sylvestris; identical to SEQ ID NO: 2258

SEQ ID NO: 13114 - DNA, 1071 bp, Arabidopsis thaliana; identical to SEQ ID NO: 2259
  CDS (1)..(1071)

SEQ ID NO: 13115 - protein, 356 aa, Arabidopsis thaliana; identical to SEQ ID NO: 2260

SEQ ID NO: 13116 - DNA, 1071 bp, Arabidopsis thaliana; identical to SEQ ID NO: 2261
  CDS (1)..(1071)

SEQ ID NO: 13117 - protein, 356 aa, Arabidopsis thaliana; identical to SEQ ID NO: 2262

SEQ ID NO: 13118 - DNA, 1065 bp, Arabidopsis thaliana; identical to SEQ ID NO: 2263
  CDS (1)..(1065)

SEQ ID NO: 13119 - protein, 354 aa, Arabidopsis thaliana; identical to SEQ ID NO: 2264

SEQ ID NO: 13120 - DNA, 1346 bp, Alnus glutinosa; identical to SEQ ID NO: 2265
  CDS (50)..(1120)

SEQ ID NO: 13121 - protein, 356 aa, Alnus glutinosa; identical to SEQ ID NO: 2266

SEQ ID NO: 13122 - DNA, 2030 bp, Chlamydomonas reinhardtii; identical to SEQ ID NO: 2267
  CDS (84)..(1232)

SEQ ID NO: 13123 - protein, 382 aa, Chlamydomonas reinhardtii; identical to SEQ ID NO: 2268

SEQ ID NO: 13124 - DNA, 1376 bp, Daucus carota; identical to SEQ ID NO: 2269
  CDS (84)..(1142)

SEQ ID NO: 13125 - protein, 352 aa, Daucus carota; identical to SEQ ID NO: 2270

SEQ ID NO: 13126 - DNA, 1359 bp, Zea mays; identical to SEQ ID NO: 2271
  CDS (10)..(1083)

SEQ ID NO: 13127 - protein, 357 aa, Zea mays; identical to SEQ ID NO: 2272

SEQ ID NO: 13128 - DNA, 1071 bp, Medicago sativa; identical to SEQ ID NO: 2273
  CDS (1)..(1071)

SEQ ID NO: 13129 - protein, 356 aa, Medicago sativa; identical to SEQ ID NO: 2274

SEQ ID NO: 13130 - DNA, 1434 bp, Pisum sativum; identical to SEQ ID NO: 2275
  CDS (83)..(1150)

SEQ ID NO: 13131 - protein, 355 aa, Pisum sativum; identical to SEQ ID NO: 2276

SEQ ID NO: 13132 - DNA, 1454 bp, Phaseolus vulgaris; identical to SEQ ID NO: 2277
  CDS (123)..(1193)

SEQ ID NO: 13133 - protein, 356 aa, Phaseolus vulgaris; identical to SEQ ID NO: 2278

SEQ ID NO: 13134 - DNA, 1450 bp, Glycine max; identical to SEQ ID NO: 2279
  CDS (78)..(1145)

SEQ ID NO: 13135 - protein, 355 aa, Glycine max; identical to SEQ ID NO: 2280

SEQ ID NO: 13136 - DNA, 1416 bp, Vitis vinifera; identical to SEQ ID NO: 2281
  CDS (88)..(1158)

SEQ ID NO: 13137 - protein, 356 aa, Vitis vinifera; identical to SEQ ID NO: 2282

SEQ ID NO: 13138 - DNA, 1324 bp, Arabidopsis thaliana; identical to SEQ ID NO: 2283
  CDS (1)..(1293)

SEQ ID NO: 13139 - protein, 430 aa, Arabidopsis thaliana; identical to SEQ ID NO: 2284

SEQ ID NO: 13140 - DNA, 1035 bp, Bradyrhizobium japonicum; identical to SEQ ID NO: 2285
  CDS (1)..(1035): transl_table=11

SEQ ID NO: 13141 - protein, 344 aa, Bradyrhizobium japonicum; identical to SEQ ID NO: 2286

SEQ ID NO: 13142 - DNA, 1537 bp, Daucus carota; identical to SEQ ID NO: 2287
  CDS (17)..(1315)

SEQ ID NO: 13143 - protein, 432 aa, Daucus carota; identical to SEQ ID NO: 2288

SEQ ID NO: 13144 - DNA, 1600 bp, Hordeum vulgare; identical to SEQ ID NO: 2289
  CDS (281)..(1585)

SEQ ID NO: 13145 - protein, 434 aa, Hordeum vulgare; identical to SEQ ID NO: 2290

SEQ ID NO: 13146 - DNA, 1369 bp, Zea mays; identical to SEQ ID NO: 2291
  CDS (103)..(1209)

SEQ ID NO: 13147 - protein, 368 aa, Zea mays; identical to SEQ ID NO: 2292

SEQ ID NO: 13148 - DNA, 1540 bp, Pisum sativum; identical to SEQ ID NO: 2293
  CDS (68)..(1360)

SEQ ID NO: 13149 - protein, 430 aa, Pisum sativum; identical to SEQ ID NO: 2294

SEQ ID NO: 13150 - DNA, 1353 bp, Phaseolus vulgaris; identical to SEQ ID NO: 2295
  CDS (116)..(1186)

SEQ ID NO: 13151 - protein, 356 aa, Phaseolus vulgaris; identical to SEQ ID NO: 2296

SEQ ID NO: 13152 - DNA, 990 bp, Rhizobium meliloti; identical to SEQ ID NO: 2297
  CDS (1)..(990): transl_table=11

SEQ ID NO: 13153 - protein, 329 aa, Rhizobium meliloti; identical to SEQ ID NO: 2298

SEQ ID NO: 13154 - DNA, 1087 bp, Glycine max; identical to SEQ ID NO: 2299
  CDS (1)..(1071)

SEQ ID NO: 13155 - protein, 356 aa, Glycine max; identical to SEQ ID NO: 2300

SEQ ID NO: 13156 - DNA, 1305 bp, Vitis vinifera; identical to SEQ ID NO: 2301
  CDS (24)..(1094)

SEQ ID NO: 13157 - protein, 356 aa, Vitis vinifera; identical to SEQ ID NO: 2302

SEQ ID NO: 13158 - DNA, 1317 bp, Zea mays; identical to SEQ ID NO: 2303
  CDS (63)..(1133)

SEQ ID NO: 13159 - protein, 356 aa, Zea mays; identical to SEQ ID NO: 2304

SEQ ID NO: 13160 - DNA, 1372 bp, Medicago sativa; identical to SEQ ID NO: 2305
  CDS (92)..(1162)

SEQ ID NO: 13161 - protein, 356 aa, Medicago sativa; identical to SEQ ID NO: 2306

SEQ ID NO: 13162 - DNA, 1373 bp, Pisum sativum; identical to SEQ ID NO: 2307
  CDS (63)..(1136)

SEQ ID NO: 13163 - protein, 357 aa, Pisum sativum; identical to SEQ ID NO: 2308

SEQ ID NO: 13164 - DNA, 1448 bp, Phaseolus vulgaris; identical to SEQ ID NO: 2309
  CDS (69)..(1139)

SEQ ID NO: 13165 - protein, 356 aa, Phaseolus vulgaris; identical to SEQ ID NO: 2310

SEQ ID NO: 13166 - DNA, 1490 bp, Zea mays; identical to SEQ ID NO: 2311
  CDS (85)..(1152)

SEQ ID NO: 13167 - protein, 355 aa, Zea mays; identical to SEQ ID NO: 2312

SEQ ID NO: 13168 - DNA, 1510 bp, Phaseolus vulgaris; identical to SEQ ID NO: 2313
  CDS (64)..(1353)

SEQ ID NO: 13169 - protein, 429 aa, Phaseolus vulgaris; identical to SEQ ID NO: 2314

SEQ ID NO: 13170 - DNA, 1575 bp, Brassica napus; identical to SEQ ID NO: 2315
  CDS (95)..(1381)

SEQ ID NO: 13171 - protein, 428 aa, Brassica napus; identical to SEQ ID NO: 2316

SEQ ID NO: 13172 - DNA, 1483 bp, Zea mays; identical to SEQ ID NO: 2317
  CDS (48)..(1319)

SEQ ID NO: 13173 - protein, 423 aa, Zea mays; identical to SEQ ID NO: 2318

SEQ ID NO: 13174 - DNA, 1245 bp, Amanita muscaria; identical to SEQ ID NO: 2319
  CDS (96)..(1160)

SEQ ID NO: 13175 - protein, 354 aa, Amanita muscaria; identical to SEQ ID NO: 2320

SEQ ID NO: 13176 - DNA, 1110 bp, Ashbya gossypii; identical to SEQ ID NO: 2321
  CDS (1)..(1110)

SEQ ID NO: 13177 - protein, 369 aa, Ashbya gossypii; identical to SEQ ID NO: 2322

SEQ ID NO: 13178 - DNA, 1119 bp, Candida glabrata; identical to SEQ ID NO: 2323
  CDS (1)..(1119)

SEQ ID NO: 13179 - protein, 372 aa, Candida glabrata; identical to SEQ ID NO: 2324

SEQ ID NO: 13180 - DNA, 1077 bp, Cryptococcus neoformans; identical to SEQ ID NO: 2325
  CDS (1)..(1077)

SEQ ID NO: 13181 - protein, 358 aa, Cryptococcus neoformans; identical to SEQ ID NO: 2326

SEQ ID NO: 13182 - DNA, 1113 bp, Debaryomyces hansenii; identical to SEQ ID NO: 2327
  CDS (1)..(1113)

SEQ ID NO: 13183 - protein, 370 aa, Debaryomyces hansenii; identical to SEQ ID NO: 2328

SEQ ID NO: 13184 - DNA, 1218 bp, Hebeloma cylindrosporum; identical to SEQ ID NO: 2329
  CDS (71)..(1135)

SEQ ID NO: 13185 - protein, 354 aa, Hebeloma cylindrosporum; identical to SEQ ID NO: 2330

SEQ ID NO: 13186 - DNA, 1119 bp, Kluyveromyces lactis; identical to SEQ ID NO: 2331
  CDS (1)..(1119)

SEQ ID NO: 13187 - protein, 372 aa, Kluyveromyces lactis; identical to SEQ ID NO: 2332

SEQ ID NO: 13188 - DNA, 1429 bp, Lactuca sativa; identical to SEQ ID NO: 2333
  CDS (16)..(1092)

SEQ ID NO: 13189 - protein, 358 aa, Lactuca sativa; identical to SEQ ID NO: 2334

SEQ ID NO: 13190 - DNA, 1340 bp, Nicotiana plumbaginifolia; identical to SEQ ID NO: 2335
  CDS (16)..(1086)

SEQ ID NO: 13191 - protein, 356 aa, Nicotiana plumbaginifolia; identical to SEQ ID NO: 2336

SEQ ID NO: 13192 - DNA, 1423 bp, Pinus sylvestris; identical to SEQ ID NO: 2337
  CDS (34)..(1107)

SEQ ID NO: 13193 - protein, 357 aa, Pinus sylvestris; identical to SEQ ID NO: 2338

SEQ ID NO: 13194 - DNA, 1080 bp, Schizosaccharomyces pombe; identical to SEQ ID NO: 2339
  CDS (1)..(1080)

SEQ ID NO: 13195 - protein, 359 aa, Schizosaccharomyces pombe; identical to SEQ ID NO: 2340

SEQ ID NO: 13196 - DNA, 1300 bp, Tuber borchii; identical to SEQ ID NO: 2341
  CDS (45)..(1121)

SEQ ID NO: 13197 - protein, 358 aa, Tuber borchii; identical to SEQ ID NO: 2342

SEQ ID NO: 13198 - DNA, 1407 bp, Vigna aconitifolia; identical to SEQ ID NO: 2343
  CDS (78)..(1148)

SEQ ID NO: 13199 - protein, 356 aa, Vigna aconitifolia; identical to SEQ ID NO: 2344

SEQ ID NO: 13200 - DNA, 1095 bp, Yarrowia lipolytica; identical to SEQ ID NO: 2345
  CDS (1)..(1095)

SEQ ID NO: 13201 - protein, 364 aa, Yarrowia lipolytica; identical to SEQ ID NO: 2346

SEQ ID NO: 13202 - DNA, 1113 bp, Saccharomyces cerevisiae; identical to SEQ ID NO: 2081
  CDS (1)..(1113)

SEQ ID NO: 13203 - protein, 370 aa, Saccharomyces cerevisiae; identical to SEQ ID NO: 2082

SEQ ID NO: 13204 - DNA, 1071 bp, Brassica napus; identical to SEQ ID NO: 2347
  CDS (1)..(1071)

SEQ ID NO: 13205 - protein, 356 aa, Brassica napus; identical to SEQ ID NO: 2348

SEQ ID NO: 13206 - DNA, 1065 bp, Brassica napus; identical to SEQ ID NO: 2349
  CDS (1)..(1065)

SEQ ID NO: 13207 - protein, 354 aa, Brassica napus; identical to SEQ ID NO: 2350

SEQ ID NO: 13208 - DNA, 1071 bp, Glycine max; identical to SEQ ID NO: 2351
  CDS (1)..(1071)

SEQ ID NO: 13209 - protein, 356 aa, Glycine max; identical to SEQ ID NO: 2352

SEQ ID NO: 13210 - DNA, 1065 bp, Triticum aestivum; identical to SEQ ID NO: 2353
  CDS (1)..(1065)

SEQ ID NO: 13211 - protein, 354 aa, Triticum aestivum; identical to SEQ ID NO: 2354

SEQ ID NO: 13212 - DNA, 1284 bp, Triticum aestivum; identical to SEQ ID NO: 2355
  CDS (1)..(1284)

SEQ ID NO: 13213 - protein, 427 aa, Triticum aestivum; identical to SEQ ID NO: 2356

SEQ ID NO: 13214 - DNA, 1110 bp, Linum usitatissimum; identical to SEQ ID NO: 2357
  CDS (1)..(1110)

SEQ ID NO: 13215 - protein, 369 aa, Linum usitatissimum; identical to SEQ ID NO: 2358

SEQ ID NO: 13216 - DNA, 1272 bp, Zea mays; identical to SEQ ID NO: 2359
  CDS (1)..(1272)

SEQ ID NO: 13217 - protein, 423 aa, Zea mays; identical to SEQ ID NO: 2360

SEQ ID NO: 13218 - DNA, 1071 bp, Zea mays; identical to SEQ ID NO: 2361
  CDS (1)..(1071)

SEQ ID NO: 13219 - protein, 356 aa, Zea mays; identical to SEQ ID NO: 2362

SEQ ID NO: 13220 - DNA, 1071 bp, Brassica napus; identical to SEQ ID NO: 2363
  CDS (1)..(1071)

SEQ ID NO: 13221 - protein, 356 aa, Brassica napus; identical to SEQ ID NO: 2364

SEQ ID NO: 13222 - DNA, 1074 bp, Brassica napus; identical to SEQ ID NO: 2365
  CDS (1)..(1074)

SEQ ID NO: 13223 - protein, 357 aa, Brassica napus; identical to SEQ ID NO: 2366

SEQ ID NO: 13224 - DNA, 1071 bp, Brassica napus; identical to SEQ ID NO: 2367
  CDS (1)..(1071)

SEQ ID NO: 13225 - protein, 356 aa, Brassica napus; identical to SEQ ID NO: 2368

SEQ ID NO: 13226 - DNA, 1071 bp, Brassica napus; identical to SEQ ID NO: 2369
  CDS (1)..(1071)

SEQ ID NO: 13227 - protein, 356 aa, Brassica napus; identical to SEQ ID NO: 2370

SEQ ID NO: 13228 - DNA, 1287 bp, Brassica napus; identical to SEQ ID NO: 2371
  CDS (1)..(1287)

SEQ ID NO: 13229 - protein, 428 aa, Brassica napus; identical to SEQ ID NO: 2372

SEQ ID NO: 13230 - DNA, 1071 bp, Glycine max; identical to SEQ ID NO: 2373
  CDS (1)..(1071)

SEQ ID NO: 13231 - protein, 356 aa, Glycine max; identical to SEQ ID NO: 2374

SEQ ID NO: 13232 - DNA, 1071 bp, Glycine max; identical to SEQ ID NO: 2375
  CDS (1)..(1071)

SEQ ID NO: 13233 - protein, 356 aa, Glycine max; identical to SEQ ID NO: 2376

SEQ ID NO: 13234 - DNA, 1071 bp, Glycine max; identical to SEQ ID NO: 2377
  CDS (1)..(1071)

SEQ ID NO: 13235 - protein, 356 aa, Glycine max; identical to SEQ ID NO: 2378

SEQ ID NO: 13236 - DNA, 1071 bp, Glycine max; identical to SEQ ID NO: 2379
  CDS (1)..(1071)

SEQ ID NO: 13237 - protein, 356 aa, Glycine max; identical to SEQ ID NO: 2380

SEQ ID NO: 13238 - DNA, 1299 bp, Glycine max; identical to SEQ ID NO: 2381
  CDS (1)..(1299)

SEQ ID NO: 13239 - protein, 432 aa, Glycine max; identical to SEQ ID NO: 2382

SEQ ID NO: 13240 - DNA, 1074 bp, Glycine max; identical to SEQ ID NO: 2383
  CDS (1)..(1074)

SEQ ID NO: 13241 - protein, 357 aa, Glycine max; identical to SEQ ID NO: 2384

SEQ ID NO: 13242 - DNA, 1071 bp, Zea mays; identical to SEQ ID NO: 2385
  CDS (1)..(1071)

SEQ ID NO: 13243 - protein, 356 aa, Zea mays; identical to SEQ ID NO: 2386

SEQ ID NO: 13244 - DNA, 1110 bp, Zea mays; identical to SEQ ID NO: 2387
  CDS (1)..(1110)

SEQ ID NO: 13245 - protein, 369 aa, Zea mays; identical to SEQ ID NO: 2388

SEQ ID NO: 13246 - DNA, 1074 bp, Zea mays; identical to SEQ ID NO: 2389
  CDS (1)..(1074)

SEQ ID NO: 13247 - protein, 357 aa, Zea mays; identical to SEQ ID NO: 2390

SEQ ID NO: 13248 - DNA, 1110 bp, Zea mays; identical to SEQ ID NO: 2391
  CDS (1)..(1110)

SEQ ID NO: 13249 - protein, 369 aa, Zea mays; identical to SEQ ID NO: 2392

SEQ ID NO: 13250 - DNA, 1071 bp, Zea mays; identical to SEQ ID NO: 2393
  CDS (1)..(1071)

SEQ ID NO: 13251 - protein, 356 aa, Zea mays; identical to SEQ ID NO: 2394

SEQ ID NO: 13252 - DNA, 24 bp, Artificial sequence
  primer
atggctgaagcaagcatcgaaaag

SEQ ID NO: 13253 - DNA, 27 bp, Artificial sequence
  primer
ttatgaagattctctttcaaattcctt

SEQ ID NO: 13254 - protein, 377 aa, Artificial sequence; identical to SEQ ID NO: 2397
  consensus sequence
  Variant (2)..(5): Xaa in position 2 to 5 is any amino acid
  Variant (6)..(16): Xaa in position 6 to 16 is any or no amino acid
  Variant (18)..(19): Xaa in position 18 to 19 is any amino acid
  Variant (25)..(26): Xaa in position 25 to 26 is any amino acid
  Variant (28)..(28): Xaa in position 28 is any amino acid
  Variant (30)..(31): Xaa in position 30 to 31 is any amino acid
  Variant (32)..(34): Xaa in position 32 to 34 is any or no amino acid
  Variant (38)..(38): Xaa in position 38 is any amino acid
  Variant (41)..(47): Xaa in position 41 to 47 is any amino acid
  Variant (48)..(52): Xaa in position 48 to 52 is any or no amino acid
  Variant (55)..(55): Xaa in position 55 is any amino acid
  Variant (58)..(58): Xaa in position 58 is any amino acid
  Variant (64)..(64): Xaa in position 64 is any amino acid
  Variant (69)..(69): Xaa in position 69 is any amino acid
  Variant (72)..(72): Xaa in position 72 is any amino acid
  Variant (74)..(74): Xaa in position 74 is any amino acid
  Variant (76)..(76): Xaa in position 76 is any amino acid
  Variant (78)..(78): Xaa in position 78 is any amino acid
  Variant (80)..(82): Xaa in position 80 to 82 is any amino acid
  Variant (87)..(87): Xaa in position 87 is any amino acid
  Variant (89)..(89): Xaa in position 89 is any amino acid
  Variant (94)..(94): Xaa in position 94 is any amino acid
  Variant (96)..(97): Xaa in position 96 to 97 is any amino acid
  Variant (99)..(99): Xaa in position 99 is any amino acid
  Variant (101)..(101): Xaa in position 101 is any amino acid
  Variant (102)..(111): Xaa in position 102 to 111 is any or no amino acid
  Variant (113)..(113): Xaa in position 113 is any amino acid
  Variant (115)..(117): Xaa in position 115 to 117 is any amino acid
  Variant (119)..(119): Xaa in position 119 is any amino acid
  Variant (121)..(122): Xaa in position 121 to 122 is any amino acid
  Variant (125)..(129): Xaa in position 125 to 129 is any amino acid
  Variant (130)..(137): Xaa in position 130 to 137 is any or no amino acid
  Variant (139)..(139): Xaa in position 139 is any amino acid
  Variant (141)..(141): Xaa in position 141 is any amino acid
  Variant (148)..(152): Xaa in position 148 to 152 is any amino acid
  Variant (153)..(154): Xaa in position 153 to 154 is any or no amino acid
  Variant (156)..(156): Xaa in position 156 is any amino acid
  Variant (160)..(160): Xaa in position 160 is any amino acid
  Variant (163)..(163): Xaa in position 163 is any amino acid
  Variant (173)..(174): Xaa in position 173 to 174 is any amino acid
  Variant (176)..(177): Xaa in position 176 to 177 is any amino acid
  Variant (179)..(180): Xaa in position 179 to 180 is any amino acid
  Variant (181)..(182): Xaa in position 181 to 182 is any or no amino acid
  Variant (187)..(189): Xaa in position 187 to 189 is any amino acid
  Variant (192)..(192): Xaa in position 192 is any amino acid
  Variant (204)..(204): Xaa in position 204 is any amino acid
  Variant (206)..(206): Xaa in position 206 is any amino acid
  Variant (215)..(215): Xaa in position 215 is any amino acid
  Variant (220)..(221): Xaa in position 220 to 221 is any amino acid
  Variant (223)..(229): Xaa in position 223 to 229 is any amino acid
  Variant (231)..(233): Xaa in position 231 to 233 is any amino acid
  Variant (235)..(236): Xaa in position 235 to 236 is any amino acid
  Variant (238)..(239): Xaa in position 238 to 239 is any amino acid
  Variant (242)..(242): Xaa in position 242 is any amino acid
  Variant (244)..(244): Xaa in position 244 is any amino acid
  Variant (246)..(247): Xaa in position 246 to 247 is any amino acid
  Variant (249)..(250): Xaa in position 249 to 250 is any amino acid
  Variant (253)..(256): Xaa in position 253 to 256 is any amino acid
  Variant (261)..(262): Xaa in position 261 to 262 is any amino acid
  Variant (264)..(264): Xaa in position 264 is any amino acid
  Variant (271)..(271): Xaa in position 271 is any amino acid
  Variant (273)..(273): Xaa in position 273 is any amino acid
  Variant (275)..(275): Xaa in position 275 is any amino acid
  Variant (278)..(279): Xaa in position 278 to 279 is any amino acid
  Variant (282)..(283): Xaa in position 282 to 283 is any amino acid
  Variant (284)..(284): Xaa in position 284 is any or no amino acid
  Variant (287)..(289): Xaa in position 287 to 289 is any amino acid
  Variant (290)..(290): Xaa in position 290 is any or no amino acid
  Variant (292)..(293): Xaa in position 292 to 293 is any amino acid
  Variant (296)..(297): Xaa in position 296 to 297 is any amino acid
  Variant (299)..(300): Xaa in position 299 to 300 is any amino acid
  Variant (301)..(301): Xaa in position 301 is any or no amino acid
  Variant (303)..(304): Xaa in position 303 to 304 is any amino acid
  Variant (307)..(308): Xaa in position 307 to 308 is any amino acid
  Variant (311)..(311): Xaa in position 311 is any amino acid
  Variant (315)..(315): Xaa in position 315 is any amino acid
  Variant (320)..(320): Xaa in position 320 is any amino acid
  Variant (325)..(325): Xaa in position 325 is any amino acid
  Variant (327)..(328): Xaa in position 327 to 328 is any amino acid
  Variant (330)..(331): Xaa in position 330 to 331 is any amino acid
  Variant (338)..(338): Xaa in position 338 is any amino acid
  Variant (340)..(340): Xaa in position 340 is any amino acid
  Variant (343)..(343): Xaa in position 343 is any amino acid
  Variant (345)..(349): Xaa in position 345 to 349 is any amino acid
  Variant (351)..(351): Xaa in position 351 is any amino acid
  Variant (355)..(355): Xaa in position 355 is any amino acid
  Variant (364)..(364): Xaa in position 364 is any amino acid
  Variant (367)..(367): Xaa in position 367 is any amino acid
  Variant (369)..(369): Xaa in position 369 is any amino acid
  Variant (372)..(376): Xaa in position 372 to 376 is any amino acid

SEQ ID NO: 13255 - protein, 41 aa, Artificial sequence; identical to SEQ ID NO: 2398
  protein pattern
  Variant (2)..(5): Xaa in position 2 to 5 is any or no amino acid
  Variant (8)..(8): Xaa in position 8 is Phe, Ile, Leu, Met or Val
  Variant (9)..(9): Xaa in position 9 is any amino acid
  Variant (10)..(10): Xaa in position 10 is Asp or Glu
  Variant (11)..(11): Xaa in position 11 is Ala, Gly or Ser
  Variant (14)..(14): Xaa in position 14 is Lys or Arg
  Variant (17)..(17): Xaa in position 17 is Ile, Leu or Val
  Variant (18)..(18): Xaa in position 18 is Phe, His or Tyr
  Variant (19)..(19): Xaa in position 19 is Ala or Ser
  Variant (21)..(21): Xaa in position 21 is Phe, Ile, Leu or Val
  Variant (22)..(22): Xaa in position 22 is any amino acid
  Variant (23)..(23): Xaa in position 23 is Ile or Val
  Variant (24)..(24): Xaa in position 24 is Gly or Ser
  Variant (26)..(27): Xaa in position 26 to 27 is any amino acid
  Variant (28)..(28): Xaa in position 28 is Ala, Gly or Pro
  Variant (31)..(31): Xaa in position 31 is Leu or Met
  Variant (33)..(33): Xaa in position 33 is Ala, Gly or Ser
  Variant (36)..(36): Xaa in position 36 is Glu or Gly
  Variant (37)..(37): Xaa in position 37 is Phe or Tyr
  Variant (39)..(39): Xaa in position 39 is Ile or Val
  Variant (40)..(40): Xaa in position 40 is Gly or Ser
  Variant (41)..(41): Xaa in position 41 is Pro or Ser

SEQ ID NO: 13256 - protein, 27 aa, Artificial sequence
  protein pattern
  Variant (4)..(4): Xaa in position 4 is His, Lys or Arg
  Variant (8)..(8): Xaa in position 8 is Ala or Gly
  Variant (9)..(10): Xaa in position 9 to 10 is any amino acid
  Variant (11)..(11): Xaa in position 11 is Asp, Gly, Asn, Ser or Thr
  Variant (12)..(12): Xaa in position 12 is any amino acid
  Variant (14)..(15): Xaa in position 14 to 15 is any amino acid
  Variant (19)..(19): Xaa in position 19 is Asp or Asn
  Variant (22)..(22): Xaa in position 22 is Ala, Cys, Gly or Ser
  Variant (24)..(24): Xaa in position 24 is Ile or Val
  Variant (26)..(26): Xaa in position 26 is Ile or Val
  Variant (27)..(27): Xaa in position 27 is Gly or Pro
LTGXHETXXXXXFXXGVAXRGXSXRXX

SEQ ID NO: 13257 - protein, 20 aa, Artificial sequence
  protein pattern
  Variant (3)..(3): Xaa in position 3 is any amino acid
  Variant (12)..(13): Xaa in position 12 to 13 is any amino acid
  Variant (15)..(16): Xaa in position 15 to 16 is any amino acid
  Variant (17)..(17): Xaa in position 17 is Ile or Val
  Variant (19)..(19): Xaa in position 19 is any amino acid
  Variant (20)..(20): Xaa in position 20 is Ile, Leu, Met or Val
GYXEDRRPASNXXPXXXTXX

SEQ ID NO: 13258 - protein, 20 aa, Artificial sequence
  protein pattern
  Variant (3)..(3): Xaa in position 3 is Glu, His or Lys
  Variant (6)..(6): Xaa in position 6 is Phe or Tyr
  Variant (12)..(15): Xaa in position 12 to 15 is any or no amino acid
  Variant (17)..(17): Xaa in position 17 is any amino acid
  Variant (18)..(18): Xaa in position 18 is Ala, Asp or Asn
  Variant (20)..(20): Xaa in position 20 is Asp or Glu
LPXWNXDGSSTXXXXGXXSX

SEQ ID NO: 13259 - protein, 11 aa, Artificial sequence
  protein pattern
  Variant (2)..(2): Xaa in position 2 is Phe or Tyr
  Variant (4)..(4): Xaa in position 4 is Ala or Gly
  Variant (11)..(11): Xaa in position 11 is Cys or Thr
GXPXPQGPYYX

SEQ ID NO: 13260 - protein, 12 aa, Artificial sequence
  protein pattern
  Variant (2)..(2): Xaa in position 2 is Phe or Tyr
  Variant (4)..(4): Xaa in position 4 is Ile or Leu
  Variant (11)..(11): Xaa in position 11 is Phe, Leu or Met
  Variant (12)..(12): Xaa in position 12 is Asp or Gln
WXGXEQEYTLXX

SEQ ID NO: 13261 - protein, 27 aa, Artificial sequence
  protein pattern
  Variant (2)..(2): Xaa in position 2 is any amino acid
  Variant (3)..(3): Xaa in position 3 is Ile, Leu or Val
  Variant (5)..(5): Xaa in position 5 is any or no amino acid
  Variant (7)..(7): Xaa in position 7 is any or no amino acid
  Variant (9)..(9): Xaa in position 9 is Phe, Trp or Tyr
  Variant (10)..(10): Xaa in position 10 is Phe, Ile, Leu or Val
  Variant (12)..(12): Xaa in position 12 is any amino acid
  Variant (14)..(14): Xaa in position 14 is any amino acid
  Variant (15)..(15): Xaa in position 15 is Ala, Cys, Gly, Ser or Thr
  Variant (17)..(18): Xaa in position 17 to 18 is any amino acid
  Variant (19)..(19): Xaa in position 19 is Ala, Asp, Glu or Gly
  Variant (20)..(21): Xaa in position 20 to 21 is any amino acid
  Variant (22)..(22): Xaa in position 22 is Ala, Ile, Leu, Pro or Val
  Variant (23)..(23): Xaa in position 23 is Glu, Asn, Ser or Thr
  Variant (24)..(25): Xaa in position 24 to 25 is any amino acid
  Variant (26)..(26): Xaa in position 26 is Cys or Pro
DXXWXAXRXXLXRXXEXXXXXXXXXXK

SEQ ID NO: 13262 - protein, 13 aa, Artificial sequence
  protein pattern
  Variant (2)..(2): Xaa in position 2 is any or no amino acid
  Variant (6)..(6): Xaa in position 6 is Ile or Val
  Variant (8)..(8): Xaa in position 8 is any amino acid
  Variant (9)..(11): Xaa in position 9 to 11 is any or no amino acid
  Variant (13)..(13): Xaa in position 13 is Gly, Asn, Ser, Thr or Val
IXAEYXWXXXXGX

SEQ ID NO: 13263 - DNA, 1128 bp, Saccharomyces cerevisiae; identical to SEQ ID NO: 3978
  CDS (1)..(1128)

SEQ ID NO: 13264 - protein, 375 aa, Saccharomyces cerevisiae; identical to SEQ ID NO: 3979

SEQ ID NO: 13265 - DNA, 954 bp, Brassica napus
  CDS (1)..(954)
atgccgatgttcaaggcgccgttcaacggctactcagtgaaattcagccctttctacgagtcccgcctcgccgtcgccacagctcagaacttcggaatcctcggaaacggccggatccacgtcctcgagctctctcccggaggtcccggcgtcacagagtccatcgccttcgacacagccgacgcagtctacgacgtctgctggtcagaatctcacgactccgtactcatcgccgccatcggcgacggctccgtgaagatctacgacacagcgctcccgcctccctccaatcccatccgatcgttccaagaacacgcgcgtgaggttcactcggttgattacaaccccacacgccgcgattctttcctcacggcgtcgtgggacgatacgatgaagctgtgggccatggatcgtccggcgagcatcaggactttcaaggagcacgcgtattgcgtttaccaagcggtttggaaccctaagcatggagacatcttcgcctctgcttccggcgactgtaccctgaggatatgggatgtgagagagcctggctccaccatgatcatccctgctcatgacttcgagatactgtcgtgtgattggaacaagtacgatgattgtgttttagcgacttcttcggtggataagacgattaaggtgtgggatgtgaggagttacagggctcctttggctgtgctcaatgggcatgggtatgcggtgaggaaggtgaagttctcgccgcataggaggaacttgattgcttcttgctcttatgatatgactgtgtgcctttgggactatatggtggaggatgctttggtgggtcggtatgaccatcacactgagtttgccgttgggattgatatgagtgttcttgttgaaggtttgatggcgagtacaggttgggacgagcttgtttatgtttggcagcaagggatggatccaagagctagttga

SEQ ID NO: 13266 - protein, 317 aa, Brassica napus
MPMFKAPFNGYSVKFSPFYESRLAVATAQNFGILGNGRIHVLELSPGGPGVTESIAFDTADAVYDVCWSESHDSVLIAAIGDGSVKIYDTALPPPSNPIRSFQEHAREVHSVDYNPTRRDSFLTASWDDTMKLWAMDRPASIRTFKEHAYCVYQAVWNPKHGDIFASASGDCTLRIWDVREPGSTMIIPAHDFEILSCDWNKYDDCVLATSSVDKTIKVWDVRSYRAPLAVLNGHGYAVRKVKFSPHRRNLIASCSYDMTVCLWDYMVEDALVGRYDHHTEFAVGIDMSVLVEGLMASTGWDELVYVWQQGMDPRAS

SEQ ID NO: 13267 - DNA, 459 bp, Saccharomyces cerevisiae; identical to SEQ ID NO: 952
  CDS (1)..(459)

SEQ ID NO: 13268 - protein, 152 aa, Saccharomyces cerevisiae; identical to SEQ ID NO: 953

SEQ ID NO: 13269 - DNA, 750 bp, Brassica napus
  CDS (1)..(750)
atgaagaagatcgatttagggaaccaccgcgagacggctcagccggaatgcatcaaagctctcattgtcgaattcatcaccacctttttctttgttttcgccggcgtcggatccgccatggccacagacagcttagtcggaaacactttggtgggacttttggcggtcgcggtggctcatgcccttgtggtggcggttatgatatctgcgggccatatctccggtggtcacctcaatcccgctgtcaccatcggcctacttttcggaggtcacatcagcgtcttccgcgcattcctctattggattgatcagctgttggcctcctccgcagcctgcttcctcttaagttaccttactggaggaatgggaactccggttcacactttggcaagtggaatcagctacacccaggggatcgtatgggagatcatcttaacattctcacttctcttcactgtctacgccacgatggtggatcccaagaaaggctcccttgatgggctaggcccacttctcacaggattcgtcgtcggagccaacatccttgccggtggcgccttctctggagcctcaatgaacccggccagatcatttggacctgctttggtctctgggaactggactgaccattgggtatattgggttggaccgttgatcggaggtggacttgctggattcatctatgagaacgtcctcattgaccgttcagatgtcccactcgccgacgacgagcaaccattcctaaattga

SEQ ID NO: 13270 - protein, 249 aa, Brassica napus
MKKIDLGNHRETAQPECIKALIVEFITTFFFVFAGVGSAMATDSLVGNTLVGLLAVAVAHALVVAVMISAGHISGGHLNPAVTIGLLFGGHISVFRAFLYWIDQLLASSAACFLLSYLTGGMGTPVHTLASGISYTQGIVWEIILTFSLLFTVYATMVDPKKGSLDGLGPLLTGFVVGANILAGGAFSGASMNPARSFGPALVSGNWTDHWVYWVGPLIGGGLAGFIYENVLIDRSDVPLADDEQPFLN

SEQ ID NO: 13271 - DNA, 861 bp, Brassica napus
  CDS (1)..(861)
atggaagggaaggaagaggatgtgagagtgggagcgaacaagttcccagagaggcagcctatcgggacatcggctcagactgacaaggactacaaggagccaccaccagcgccgctgttcgagccaggggagctgagctcgtggtctttctggagagcagggatcgcagagttcatagctaccttcctgttcctttacatcacagtattgacggtgatgggagtgaagagagcaccaaacatgtgtgcatctgtcggaatccaaggcatagcttgggcttttggtggcatgatctttgccctcgtctactgtactgccggaatctccggtggacacataaacccagcggtgacattcgggctgttcttagctcggaaactttcactgaccagagctgtcttctacatggtcatgcaatgcctcggtgccatctgcggcgccggtgttgtcaaaggcttccagccttccccctaccaaaccctcggcggcggagccaacacagtcgctcccggctacaccaaaggatctggactcggagctgagatcatcggaaccttcgtccttgtctacaccgtcttctcagccaccgacgccaagagaagcgcccgtgactcacacgttccgattttggctccactcccaatcggattcgctgtgtttttggttcacttggcgacgatcccgatcaccgggaccggtattaacccagctcggagtctaggagctgcaatcatctacaacaaggaccactcctgggatgaccactggatattctgggtgggaccattcatcggagcagctcttgcggctctctaccaccagcttgtcatcagagctattcctttcaagaccagaacctga

SEQ ID NO: 13272 - protein, 286 aa, Brassica napus
MEGKEEDVRVGANKFPERQPIGTSAQTDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMVMQCLGAICGAGVVKGFQPSPYQTLGGGANTVAPGYTKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHQLVIRAIPFKTRT

SEQ ID NO: 13273 - DNA, 747 bp, Triticum aestivum
  CDS (1)..(747)
atgccgggctccatcgccttcggtcgcttcgatgactccttcagcttggcctctttcagggcctacatcgccgagttcatctccaccctcatcttcgtcttcgccggcgtcggctctgtcatcgcctacaccaaggtgagcggcggcgcgccgcttgacccatccgggctgatcgccgtggcgatttgccacgggtttgggctgttcgtcgcggtcgccatcggcgccaacatctccggcggccatgtgaaccctgccgtcaccttcggcctcgccctcggcggccagatcaccatcctcaccggcatcttctactgggttgcccagctcctcggcgccatcgtcggcgccttcctcgtccagttctgcaccggcgtggccacccctacacacgggctttccggcgtgggcgcctttgagggcgtcgtgatggagatcatcgtcaccttcgggctcgtctacaccgtgtacgccaccgccgccgaccccaagaagggatccctcggcaccatcgcccccatcgccatcggcttcatcgtcggcgccaacatcctcgtggccggccccttctccggcgggtccatgaaccctgcacgctccttcggccccgccgttgccagcggcgacttcaccaacatctgggtctactgggccggcccgctcatcggcggtggcctcgccggcgtcgtctaccgatacctatacatgtgcgacgaccacagccccgtcgccggcaacgactactaa

SEQ ID NO: 13274 - protein, 248 aa, Triticum aestivum
MPGSIAFGRFDDSFSLASFRAYIAEFISTLIFVFAGVGSVIAYTKVSGGAPLDPSGLIAVAICHGFGLFVAVAIGANISGGHVNPAVTFGLALGGQITILTGIFYWVAQLLGAIVGAFLVQFCTGVATPTHGLSGVGAFEGVVMEIIVTFGLVYTVYATAADPKKGSLGTIAPIAIGFIVGANILVAGPFSGGSMNPARSFGPAVASGDFTNIWVYWAGPLIGGGLAGVVYRYLYMCDDHSPVAGNDY
